(12) United States Patent
Choi et al.

(10) Patent No.: US 9,371,537 B2
(45) Date of Patent: Jun. 21, 2016

(54) PLANTS HAVING ENHANCED YIELD-RELATED TRAITS RESULTED FROM MODULATED EXPRESSION OF A SGT1 POLYPEPTIDE AND A METHOD FOR MAKING THE SAME

(75) Inventors: Yang Do Choi, Seoul (KR); Doil Choi, Seoul (KR); Christophe Reuzeau, La Chapelle Gonaguet (FR); Ji-Young Song, Daejeon (KR); Youn-Il Park, Daejeon (KR)

(73) Assignees: BASF Plant Science Company GmbH, Ludwigshafen (DE); Crop Functional Genomics Center, Seoul (KR)

( * ) Notice: Subject to any disclaimer, the term of this patent is extended or adjusted under 35 U.S.C. 154(b) by 740 days.

(21) Appl. No.: 13/498,003

(22) PCT Filed: Sep. 24, 2010

(86) PCT No.: PCT/EP2010/064095
§ 371 (c)(1),
(2), (4) Date: Mar. 23, 2012

(87) PCT Pub. No.: WO2011/036232
PCT Pub. Date: Mar. 31, 2011

(65) Prior Publication Data
US 2013/0145497 A1 Jun. 6, 2013

Related U.S. Application Data

(60) Provisional application No. 61/252,220, filed on Oct. 16, 2009, provisional application No. 61/252,215, filed on Oct. 16, 2009, provisional application No. 61/260,942, filed on Nov. 13, 2009.

(30) Foreign Application Priority Data

Sep. 25, 2009 (EP) ..................... 09171364
Sep. 25, 2009 (EP) ..................... 09171385
Nov. 13, 2009 (EP) ..................... 09175989

(51) Int. Cl.
C12N 15/82 (2006.01)
C07K 14/415 (2006.01)
C12N 9/14 (2006.01)
C12N 9/16 (2006.01)

(52) U.S. Cl.
CPC .......... *C12N 15/8262* (2013.01); *C07K 14/415* (2013.01); *C12N 9/14* (2013.01); *C12N 9/16* (2013.01); *C12N 15/827* (2013.01); *C12N 15/8261* (2013.01); *C12N 15/8273* (2013.01)

(58) Field of Classification Search
USPC ....................................................... 800/289
See application file for complete search history.

(56) References Cited

U.S. PATENT DOCUMENTS 7,541,172 B2 * 6/2009 Wallaart et al. ............... 435/232
7,589,256 B2 * 9/2009 Plesch et al. .................. 800/295

FOREIGN PATENT DOCUMENTS

WO WO-2005/113777 A1 12/2005

OTHER PUBLICATIONS

Chung et al. (Suppression of pepper SGT1 and SKP1 causes severe retardation of plant growth and compromises basal resistance, 126 Physiologia Plantanum, 605-617 (2006)).*
Chung et al., Suppression of pepper SGT1 and SKP1 causes severe retardation of plant growth and compromises basal resistance, 126 Physiologia Plantarum 605-617 (2006); of record IDS Apr. 13, 2012).*
Wang et al., OsRAR1 and OsSGT1 physically interact and function in rice basal disease resistance, 21 MPMI No. 3, 294-303 at 295 (2008); of record IDS Apr. 13, 2012).*
Azevedo et al. (Role of SGT1 in resistance protein accumulation in plant immunity, 25 EMBO J 2007-2016 (2006); of record IDS Apr. 13, 2012).*
GenBank Accession No. AF192467 published Dec. 16, 1999.*
GenBank Accession No. AAF18438 published Dec. 16, 1999.*
Azevedo, C., et al., "Role of SGT1 in Resistance Protein Accumulation in Plant Immunity", The EMBO Journal, 2006, vol. 25, No. 9, pp. 2007-2016.
Choe, S., et al., "Overexpression of DWARF4 in the Brassinosteroid Biosynthetic Pathway Results in Increased Vegetative Growth and Seed Yield in *Arabidopsis*", The Plant Journal, 2001, vol. 26, No. 6, pp. 573-582.
Chung, E., et al., "Suppression of Pepper SGT1 and SKP1 Causes Severe Retardation of Plant Growth and Compromises Basal Resistance", Physiologia Plantarum, 2006, vol. 126, pp. 605-617.
Gray, W.M., et al., "Arabidopsis SGT1b is Required for $SCF^{TIR1}$-Mediated Auxin Response", The Plant Cell, 2003, vol. 15, pp. 1310-1319.
Noel, L.D., et al., "Interaction between SGT1 and Cytosolic/Nuclear HSC70 Chaperones Regulates *Arabidopsis* Immune Response", The Plant Cell, 2007, vol. 19, pp. 4061-4076.
Van Camp, W., et al., "Yield Enhancement Genes: Seeds for Growth", Current Opinion in Biotechnology, 2005, vol. 16, pp. 147-153.

(Continued)

*Primary Examiner* — Medina A Ibrahim
*Assistant Examiner* — Steven Bernacki
(74) *Attorney, Agent, or Firm* — Drinker Biddle & Reath LLP

(57) ABSTRACT

The present invention relates generally to the field of molecular biology and concerns a method for enhancing yield-related traits in plants by modulating expression in a plant of a nucleic acid encoding an SGT1 polypeptide, or a CLC-pKG polypeptide, or a HD-hydrolase-like polypeptide. The present invention also concerns plants having modulated expression of a nucleic acid encoding an SGT1 polypeptide, or a CLC-pKG polypeptide, or a HD-hydrolase-like polypeptide, which plants have enhanced yield-related traits relative to corresponding wild type plants or other control plants. The invention also provides constructs useful in the methods of the invention.

20 Claims, 31 Drawing Sheets

(56) References Cited

OTHER PUBLICATIONS

Wang, Y., et al., "OsRAR1 and OsSGT1 Physically Interact and Function in Rice Basal Disease Resistance", Molecular Plant-Microbe Interactions, 2008, vol. 21, No. 3, pp. 294-303.
International Search Report for PCT/EP2010/064095, mailed Feb. 17, 2011.
International Preliminary Report on Patentability for PCT/EP2010/064095, issued Mar. 27, 2012.
Aravind, L., et. al., "The HD domain defines a new superfamily of metal-dependent phosphohydrolases", Trends in Biochemical Science, vol. 23, (1998), pp. 469-472.
Azevedo, C., et. al., " Role of SGT1 in resistance protein accumulation in plant immunity", The EMBO Journal, vol. 25, (2006), pp. 2007-2016.
Choe, S., et. al., "Overexpression of DWARF4 in the brassinosteroid biosynthetic pathway results in increased vegetative growth and seed yield in *Arabidopsis*", Plant Journal, vol. 26, No. 6, (2001), pp. 573-582.
Chung, E., et. al., "Suppression of pepper SGT1 and SKP1 causes severe retardation of plant growth and compromises basal resistance", Physiologia Plantarum, vol. 126, (2006), pp. 605-617.
De Angeli, A., et. al., "The nitrate/proton antiporter AtCLCa mediates nitrate accumulation in plant vacuoles", Nature, vol. 442, (2006), pp. 939-942.
De Angeli, A., et. al., "Review. CLC-mediated anion transport in plant cells", Philosophical Transactions of the Royal Society, vol. 364, (2009), pp. 195-201.
Galperin, M., et. al., "A specialized version of the HD hydrolase domain implicated in signal transduction", Journal of Molecular Microbiology and Biotechnology, vol. 1, No. 2, (1999), pp. 303-305.
Gray, W., et. al., "Arabidopsis SGT1b Is Required for SCF(TIR1)-Mediated Auxin Response", Plant Cell, vol. 15, (2003), pp. 1310-1319.
Hamill, O., et. al., "Improved patch-clamp techniques for high-resolution current recording from cells and cell-free membrane patches", Pflügers Archiv : European Journal of Physiology, vol. 391, (2003), pp. 85-100.
Marmagne, A., et. al., "Two members of the *Arabidopsis* CLC (chloride channel) family, AtCLCe and AtCLCf, are associated with thylakoid and Golgi membranes, respectively", Journal of Experimental Botany, vol. 58, No. 12, (2007), pp. 3385-3393.
Noël, L., et. al., "Interaction between SGT1 and Cytosolic/Nuclear HSC70 Chaperones Regulates *Arabidopsis* Immune Responses", The Plant Cell, vol. 19, (2007), pp. 4061-4076.
Van Camp, W., "Yield enhancement genes: seeds for growth", Current Opinion in Biotechnology, vol. 16, (2005), pp. 147-153.
Wang, Y., et. al., "OsRAR1 and OsSGT1 physically interact and function in rice basal disease resistance", Molecular Plant-Microbe Interactions, vol. 21, No. 3, (2008), pp. 294-303.

\* cited by examiner

CLUSTAL W (1.81) multiple sequence alignment

```
A.thaliana_AT4G23570.1#1                 ----MAKELADKAKEAFVDDDFDVAVDLYSKAIDLDPNCAEFFADRAQAY
A.thaliana_AT4G23570.2#1                 ----MAKELADKAKEAFVDDDFDVAVDLYSKAIDLDPNCAEFFADRAQAY
A.thaliana_AT4G23570.3#1                 ----MAKELADKAKEAFVDDDFDVAVDLYSKAIDLDPNCAEFFADRAQAY
A.thaliana_AT4G11260.1#1                 ----MAKELAEKAKEAFLDDDFDVAVDLYSKAIDLDPNCAAFFADRAQAN
B.napus_BN06MC26625_51284379@2           ----MAKELAEKAKEAFLDDDFDVAVDLYSKAIDLDPSCASFFADRAQAN
Z.mays_ZM07MC27211_BFb0187N13@           ---MAASDLESKAKEAFVDDDFELAAELYTQAIDAGPATADLYADRAQAH
Z.mays_ZM07MC23831_BFb0038K08@           ---MAASDLESKAKEAFVDDDFELATELYSQAIDAGPATADLYADRAQAH
O.sativa_LOC_Os01g43540.1#1              MATAAASDLESKAKAAFVDDDFELAAELYTQAIEASPATAELYADRAQAH
T.aestivum_TC280790#1                    --------------------------------------------------
M.truncatula_CT025844_7.4#1              ----MAQELENKAKEAFFDDDFTLAVDFYSQAIEIDPTNANLFADRAQSH
G.max_GM06MC38560_sab91h08@375           ----MASDLEAKAKEAFVEDHFELAVDLLSQAIHLEPNKAEFYADRAQAN
TraitMillCDS_25598_CDS6534_69_           ----MASDLETRAKEAFIDDHFELAVDLYTQAISLSPKNPELFADRAQAN
SGT1_from_Pepper__KOGENT2_               ----MASDLETRAKEAFIDDHFELAVDLYTQAISLSPKNPELFADRAQAN
S.lycopersicum_TC192025#1                ----MASDLETRAKEAFIDDHFELAVDLYTQAITLSPKNPELFADRAQAN
S.lycopersicum_NP9243669#1               ----MASDLETRAKEAFIDDHFELAVDLYTQAIAMTPKNAELFADRAQAN
P.trichocarpa_scaff_IV.839#1             -----MADLEKKAKEAFIDDHFELAVDLYTQAIALNPTNPDLLADRAQAN
P.trichocarpa_scaff_44.273#1             -----MADLERKAKEAFIDDHFELAVDLYTQAIALNPTNPDLFADRAQAN
S.lycopersicum_AW398985#1                ----MASDLVTKAKEAFIDDHFELAVDLYSQAIAITPNNADLFADRAQAN
H.vulgare_c62589592hv270303@64           ----MADEAKAKGNAAFSAGRFEEAAGHFSDAIALAPANHVLYSNRSAAL A.thaliana_AT4G23570.1#1                 IKLESFT-EAVADANKAIELDPSLTKAYLRKGTACMKLEEYRTAKTALEK
A.thaliana_AT4G23570.2#1                 IKLESFT-EAVADANKAIELDPSLTKAYLRKGTACMKLEEYRTAKTALEK
A.thaliana_AT4G23570.3#1                 IKLESFTAEAVADANKAIELDPSLTKAYLRKGTACMKLEEYRTAKTALEK
A.thaliana_AT4G11260.1#1                 IKIDNFT-EAVVDANKAIELEPTLAKAYLRKGTACMKLEEYSTAKAALEK
B.napus_BN06MC26625_51284379@2           IKLLNFT-EAVADANKAIELEPTLAKAYLRKGTACMKLEEYATAKAALEK
Z.mays_ZM07MC27211_BFb0187N13@           IKLGNYT-EAVADANKAIGLDPTMHKAYYRKGAACIKLEEYQTAKAALEL
Z.mays_ZM07MC23831_BFb0038K08@           IKLGNYT-EAVADANKAIELDPMMHKAYYRKGAACIKLEEYQTAKAALEL
O.sativa_LOC_Os01g43540.1#1              IKLGNYT-EAVADANKAIELDPSMHKAYLRKGAACIRLEEYQTAKAALEL
T.aestivum_TC280790#1                    --------------------------------------------------
M.truncatula_CT025844_7.4#1              IKLNAFT-EAVSDANKAIQLNPNLSKAYLRKGTACINLEEYHTAKVALEK
G.max_GM06MC38560_sab91h08@375           IKLNNFT-EAVADANKAIELNPSLPKAYLRKGTACMKLEEYETAKAALEV
TraitMillCDS_25598_CDS6534_69_           IKLNYFT-EAVVDANKAIELDPYMSKAYLRKGLACMKLEEYQTAKAALET
SGT1_from_Pepper__KOGENT2_               IKLNYFT-EAVVDANKAIELDPYMSKAYLRKGLACMKLEEYQTAKAALET
S.lycopersicum_TC192025#1                IKLNYFT-EAVVDANKAIELDPTMSKAYLRKGLACMKLEEYQTAKAALEI
S.lycopersicum_NP9243669#1               IKLNYFT-EAVVDANKAIELDPSMSKAYLRKGLACMKLEEYQTAKAALQT
P.trichocarpa_scaff_IV.839#1             IKLNSLT-GMLN--------------------------------------
P.trichocarpa_scaff_44.273#1             IKLNNFT-EAVADASRAIALDASLAKAYLRKGIACMKLEEYQTAKAALEV
S.lycopersicum_AW398985#1                IKLRKFT-------------------------------------------
H.vulgare_c62589592hv270303@64           ASIHRYS-DALADAEKTVELKPDWAKGYSRLGAAHLGLGDAASAAAAYEK A.thaliana_AT4G23570.1#1                 GASITPSESKFKKLIDECNFLITEEEKDLVQPVPSTLPSSVTAPPVSELD
A.thaliana_AT4G23570.2#1                 GASITPSESKFKKLIDECNFLITEEEKDLVQPVPSTLPSSVTAPPVSELD
A.thaliana_AT4G23570.3#1                 GASITPSESKFKKLIDECNFLITEEEKDLVQPVPSTLPSSVTAPPVSELD
A.thaliana_AT4G11260.1#1                 GASVAPNEPKFKKMIDECDLRIAEEEKDLVQPMPPSLPSSSTTPLATEAD
B.napus_BN06MC26625_51284379@2           GASVAPNESKFEKMIDECNLLIAEEEKDLVQQVPPTLPSSSTTPLAIAAD
Z.mays_ZM07MC27211_BFb0187N13@           GSSYAPGDSRFTRLLKECDECIAEESSQAPAKNVEA-----PVAATVEDK
Z.mays_ZM07MC23831_BFb0038K08@           GSSYASGDSRFARLLKECDERIAEESSQAPVKNVEA-----TVAATIEDK
O.sativa_LOC_Os01g43540.1#1              GYSFASGDSRFTRLMKECDERIAEELSEVPVKKAEDGAAAPSVASFVEEK
T.aestivum_TC280790#1                    ---------MIVLLRRASQVPVKNAAAAVASATSSGASSGATTVATEAED
M.truncatula_CT025844_7.4#1              GASFAPDDSRFTNLIQQCQRFIAAEEESESLTSTLPPNGPKSSVASVDDTH
G.max_GM06MC38560_sab91h08@375           GASLSPDNSRFATLIKECDKLIAEESYTPPIIEEKTTTEDATPKDVQQQD
TraitMillCDS_25598_CDS6534_69_           GASLAPGESRFTKLMKECDESIAEEAGELPNISLEKTSANAVASSASELS
SGT1_from_Pepper__KOGENT2_               GASLAPGESRFTKLMKECDESIAEEAGELPNISLEKTSANAVASSASELS
S.lycopersicum_TC192025#1                GASLAPGELRFSKLMKECDEHIAEEAGELPNLSVDKTSASVVAHPASELP
S.lycopersicum_NP9243669#1               GASLAPAESRFTKLIKECDERIAEEAGELPNQSVDKTSGNVVTAPP-ESL
P.trichocarpa_scaff_IV.839#1             --------------------------------------------------
P.trichocarpa_scaff_44.273#1             GASLAPGESRFTNLIKECDECIAEETGGSKNHAADAPVNTVSIEDVEPED
S.lycopersicum_AW398985#1                --------------------------------------------------
H.vulgare_c62589592hv270303@64           GLALDPSNEGLKAGLADAKKAAAAPPRRPPSGGADAIGQMFQGPELWTKI
```

FIGURE 1

```
A.thaliana_AT4G23570.1#1                VTPT------------------------------------------
A.thaliana_AT4G23570.2#1                VTPT------------------------------------------
A.thaliana_AT4G23570.3#1                VTPT------------------------------------------
A.thaliana_AT4G11260.1#1                APPVPIPA--------------------------------------
B.napus_BN06MC26625_5128437902          APPVPSPA--------------------------------------
Z.mays_ZM07MC27211_BFb0187N13@          EDVANMDN--------------------------------------
Z.mays_ZM07MC23831_BFb0038K08@          EDFTNMEN--------------------------------------
O.sativa_LOC_Os01g43540.1#1             DDAANMDN--------------------------------------
T.aestivum_TC280790#1                   QDGANMEN--------------------------------------
M.truncatula_CT025844_7.4#1             MCDKSDETSK------------------------------------
G.max_GM06MC38560_sab91h08@375          DLLEKPTVT-------------------------------------
TraitMillCDS_25598_CDS6534_69_          DNVAIAPRDP------------------------------------
SGT1_from_Pepper__KOGENT2_              DNVAIAPRDP------------------------------------
S.lycopersicum_TC192025#1               DNVAIAPEGA------------------------------------
S.lycopersicum_NP9243669#1              DNVAVAPKDA------------------------------------
P.trichocarpa_scaff_IV.839#1            ----------------------------------------------
P.trichocarpa_scaff_44.273#1            TSSQAPMVI-------------------------------------
S.lycopersicum_AW398985#1               ----------------------------------------------
H.vulgare_c62589592hv270303@64          ASDPATRAYLDQPDFMQMLRDVQRDPSSLNMFLSDPRMMQVLSLMLNIKI A.thaliana_AT4G23570.1#1                -------------------------AKYRHEYYQKPEEVVVTVFAKGIP
A.thaliana_AT4G23570.2#1                -------------------------AKYRHEYYQKPEEVVVTVFAKGIP
A.thaliana_AT4G23570.3#1                -------------------------AKYRHEYYQKPEEVVVTVFAKGIP
A.thaliana_AT4G11260.1#1                ----------------------APAKPMFRHEFYQKPEEAVVTIFAKKVP
B.napus_BN06MC26625_5128437902          ----------------------PPAKPMFRHEFYQKPEEVVVTIFAKGIP
Z.mays_ZM07MC27211_BFb0187N13@          ----------------TPPVVEPPSKPKYRHDYYNSATEVVLTIYAKGVP
Z.mays_ZM07MC23831_BFb0038K08@          ----------------TPPVIEPPSKPKYRHDYYNSATEVVLTIFAKGVP
O.sativa_LOC_Os01g43540.1#1             ----------------TPPMVEVK--PKYRHDFYNSATEVVLTIFAKGVP
T.aestivum_TC280790#1                   ----------------AQPTVEVPSKPKYRHDYYNTPTEVVLTIFAKGVP
M.truncatula_CT025844_7.4#1             --------EPQRDSPASQTNAVAPVRPKYRHEYYQKPEEVVVTIFAKGIP
G.max_GM06MC38560_sab91h08@375          ----------------------VTKPKYRHFYQKHDQLVVTIFAKKIP
TraitMillCDS_25598_CDS6534_69_          --------QSTVN----LSHQESAAKPKYRHEFYQKPEEVVVTIFAKGIP
SGT1_from_Pepper__KOGENT2_              --------QSTVN----LSHQESAAKPKYRHEFYQKPEEVVVTIFAKGIP
S.lycopersicum_TC192025#1               --------QPTVN----QSHQGSAAKPKYRHEFYQKPEEVVVTIFAKGIP
S.lycopersicum_NP9243669#1              --------QPSVN----LSYQGSAARPKYRHEFYQKPEEVVVTIFAKGIP
P.trichocarpa_scaff_IV.839#1            --------------------------------------------------
P.trichocarpa_scaff_44.273#1            ---------------------PSKPKYRHEFYQKPEEVVVSIFAKGVQ
S.lycopersicum_AW398985#1               --------------------------------------------------
H.vulgare_c62589592hv270303@64          QTPQDSDFPQSSSPSQPPPQQQRQQPETKAREMEPEPQPEPMEVSDEDKE A.thaliana_AT4G23570.1#1                KQNVNIDFGEQILSVVIEVPGEDAYYLQPRLFGKIIPDKCKYEVLSTKIE
A.thaliana_AT4G23570.2#1                KQNVNIDFGEQILSVVIEVPGEDAYYLQPRLFGKIIPDKCKYEVLSTKIE
A.thaliana_AT4G23570.3#1                KQNVNIDFGEQILSVVIEVPGEDAYYLQPRLFGKIIPDKCKYEVLSTKIE
A.thaliana_AT4G11260.1#1                KENVTVEFGEQILSVVIDVAGEEAYHLQPRLFGKIIPEKCRFEVLSTKVE
B.napus_BN06MC26625_5128437902          KQNVNVEFGDQILSVVIDVAGEEAYHFQPRLFGKIIPEKCRYEVLSTKVE
Z.mays_ZM07MC27211_BFb0187N13@          ADSVVIDFGDQMLSVSIEVPGEEPYHFQPRLFSKIIPEKCKYQVLSTKVE
Z.mays_ZM07MC23831_BFb0038K08@          ADSVVIDFGEQMLSVSIEVPGEEPYHFQPRLFSKIIPEKCKYQVLSTKVE
O.sativa_LOC_Os01g43540.1#1             AENVVVDFGEQMLSVSIEVPGEEPYHFQPRLFSKIIPEKSRYQVLSTKVE
T.aestivum_TC280790#1                   ADSVVVDFGEQMLSVSIELPGEEPYHFQPRLFSKIVPDKCKYTVLSTKVE
M.truncatula_CT025844_7.4#1             AENVVVDFGEQILSVTIDVPGQDAYHYQPRLFGKIIPDKCKVVLSTKIE
G.max_GM06MC38560_sab91h08@375          KESITVDFGEQILSVSINVPGEDTYAFQPRLFGKIIPSNCQYEVLSTKIE
TraitMillCDS_25598_CDS6534_69_          AKNVVVDFGEQILSVSIDLPGGETYSFQPRLFGKITPAKCRYEVMSTKIE
SGT1_from_Pepper__KOGENT2_              AKNVVVDFGEQILSVSIDLPGGETYSFQPRLFGKITPAKCRYEVMSTKIE
S.lycopersicum_TC192025#1               AKNVVVDFGEQILSVSIDVPGEETYSFQPRLFGKITPAKCRYEVMSTIIE
S.lycopersicum_NP9243669#1              AKNVVVDFGEQILSVSIDVPGEEAYSFQPRLFGKITPAKCRYEVMSTKIE
P.trichocarpa_scaff_IV.839#1            --------------------------------------------------
P.trichocarpa_scaff_44.273#1            ASWISVDFGEQILSVRIEVPGEDGYHFQPRLFGKIIPDKCKYNILSTKVE
S.lycopersicum_AW398985#1               --------------------------GNLFVNMVPLHSR---------
H.vulgare_c62589592hv270303@64          KKERKAAALKEKEAGNASYKKKDFETAIQHYTKAMELDDEDISYLTNRAA
```

FIGURE 1 (continued)

```
A.thaliana_AT4G23570.1#1             ICLAK----------------------------------ADIITWAS
A.thaliana_AT4G23570.2#1             ICLAK----------------------------------ADIITWAS
A.thaliana_AT4G23570.3#1             ICLAK----------------------------------ADIITWAS
A.thaliana_AT4G11260.1#1             IRLAK----------------------------------AEIITWAS
B.napus_BN06MC26625_51284379@2       IRLAK----------------------------------AEIVTWAS
Z.mays_ZM07MC27211_BFb0187N13@       IRLAK----------------------------------AEQVTWTT
Z.mays_ZM07MC23831_BFb0038K08@       IRLAK----------------------------------AEQVTWTT
O.sativa_LOC_Os01g43540.1#1          IRLAK----------------------------------AEQITWTS
T.aestivum_TC280790#1                MRLAK----------------------------------AEPVTWTS
M.truncatula_CT025844_7.4#1          IRLAK----------------------------------AEAVNWTS
G.max_GM06MC38560_sab91h08@375       IRLAK----------------------------------AEPIHWTS
TraitMillCDS_25598_CDS6534_69_       IRLAK----------------------------------AEPLHWTS
SGT1_from_Pepper__KOGENT2_           IRLAK----------------------------------AEPLHWTS
S.lycopersicum_TC192025#1            IRLAK----------------------------------AELLHWTS
S.lycopersicum_NP9243669#1           IRLAK----------------------------------AEPLHWTS
P.trichocarpa_scaff_IV.839#1         ------------------------------------------------
P.trichocarpa_scaff_44.273#1         FRLAK----------------------------------AEPGLHWA
S.lycopersicum_AW398985#1            ------------------------------------------------
H.vulgare_c62589592hv270303@64       VYIEMGKFDECIADCDKAVERGRELRADFKMVARALTRKGTALAKLAKNS A.thaliana_AT4G23570.1#1             LEHGKGPAVLPKPNVSSEVS-QRPAYPSSKK-VKDWDKLEAEVKKQEKDE
A.thaliana_AT4G23570.2#1             LEHGKGPAVLPKPNVSSEVS-QRPAYPSSKK-VKDWDKLEAEVKKQEKDE
A.thaliana_AT4G23570.3#1             LEHGKGPAVLPKPNVSSEVS-QRPAYPSSKK-VKDWDKLEAEVKKQEKDE
A.thaliana_AT4G11260.1#1             LEYGKGQSVLPKPNVSSALS-QRPVYPSSKP-AKDWDKLEAEVKKQEKDE
B.napus_BN06MC26625_51284379@2       LEYGKGQALLPKPNVASAVS-QRPVYPSSKP-GKDWDKLEAEVKKQEKDE
Z.mays_ZM07MC27211_BFb0187N13@       LDYSGRPKAIPQKISTPAETAPRPSYPSSKS-KKDWDKLEAEVKKEEKEE
Z.mays_ZM07MC23831_BFb0038K08@       LDYSGRPKTVPQKISTPAETAPRPSYPSSKA-KKDWDKLEAEVKKEEKEE
O.sativa_LOC_Os01g43540.1#1          LDYDKKPKAVPQKIIPPAESAQRPSYPSSKS-KKDWDKLEAEVKKEEKEE
T.aestivum_TC280790#1                LDYTGKP-KAPQKINVPAESAQRPSYPSSKS-KKDWDKLEAEVKKQEKDE
M.truncatula_CT025844_7.4#1          LEY--SKDVLPQKIIVPSVQSERPAYPSSKSRTKDWDKLEAEVKKEEKEE
G.max_GM06MC38560_sab91h08@375       LEFTRDIVVQQRVNASSVTGSQRPSYPSSKQ-TRDWDKIEAQVKKEEKDE
TraitMillCDS_25598_CDS6534_69_       LDYTREPVVIHRPVVSSAAP--RPSYPSSKLRNVDWDKLEAQVKKEEKDE
SGT1_from_Pepper__KOGENT2_           LDYTREPVVIHRPVVSSAAP--RPSYPSSKLRNVDWDKLEAQVKKEEKDE
S.lycopersicum_TC192025#1            LEYTTEPVVIQRPIVSSAAP--RPSYPSSKLRNVDWDKLEAQVKKEEKDE
S.lycopersicum_NP9243669#1           LEYTREPAVVQRPNVSSDAP--RPSYPSSKLRHVDWDKLEAEVKKEEKDE
P.trichocarpa_scaff_IV.839#1         --------------------------------------------------
P.trichocarpa_scaff_44.273#1         SLEYNKETAVVQRIAVSSEIVQKPTYSSSKPKRVDWDKIEAQVKKEEKEE
S.lycopersicum_AW398985#1            --------------------------------------------------
H.vulgare_c62589592hv270303@64       KDYDIAIETFQKALTEHRNPDTLKRLNEAEKAKKDLEQQEYYDPKIADEE A.thaliana_AT4G23570.1#1             KLEGDAALN----------------------------------------
A.thaliana_AT4G23570.2#1             KLEGDAALN----------------------------------------
A.thaliana_AT4G23570.3#1             KLEGDAALN----------------------------------------
A.thaliana_AT4G11260.1#1             KLDGDAAMN----------------------------------------
B.napus_BN06MC26625_51284379@2       KLDGDAAMN----------------------------------------
Z.mays_ZM07MC27211_BFb0187N13@       KLEGDAALN----------------------------------------
Z.mays_ZM07MC23831_BFb0038K08@       KLDGDAALN----------------------------------------
O.sativa_LOC_Os01g43540.1#1          KLEGDAALN----------------------------------------
T.aestivum_TC280790#1                KLDGDAALN----------------------------------------
M.truncatula_CT025844_7.4#1          KLDGDAALN----------------------------------------
G.max_GM06MC38560_sab91h08@375       KLDGDAALN----------------------------------------
TraitMillCDS_25598_CDS6534_69_       KLDGDAALN----------------------------------------
SGT1_from_Pepper__KOGENT2_           KLDGDAALN----------------------------------------
S.lycopersicum_TC192025#1            KLDGDAALN----------------------------------------
S.lycopersicum_NP9243669#1           KLDGDAALN----------------------------------------
P.trichocarpa_scaff_IV.839#1         --------------------------------------------------
P.trichocarpa_scaff_44.273#1         KLDGDAALN----------------------------------------
S.lycopersicum_AW398985#1            --------------------------------------------------
H.vulgare_c62589592hv270303@64       REKGNEMFKQQKYPEAIKHYNEAIRRNPKDARVYSNRAACYTKLGAMPEG
```

FIGURE 1 (continued)

```
A.thaliana_AT4G23570.1#1                 -------------------------KFFREIYQNADEDMRR---------A
A.thaliana_AT4G23570.2#1                 -------------------------KFFREIYQNADEDMRR---------A
A.thaliana_AT4G23570.3#1                 -------------------------KFFREIYQNADEDMRR---------A
A.thaliana_AT4G11260.1#1                 -------------------------KFFSDIYSSADEDMRR---------A
B.napus_BN06MC26625_51284379@2           -------------------------KFFSDIYQSADEDMRR---------A
Z.mays_ZM07MC27211_BFb0187N13@           -------------------------KFFRDIYKDADEDMRR---------A
Z.mays_ZM07MC23831_BFb0038K08@           -------------------------KFFRDIYKDADEDMRR---------A
O.sativa_LOC_Os01g43540.1#1              -------------------------KFFRDIYSDADEDMRR---------A
T.aestivum_TC280790#1                    -------------------------KFFREIYSDADEDMRR---------A
M.truncatula_CT025844_7.4#1              -------------------------KLFRDIYQNADEDMRR---------A
G.max_GM06MC38560_sab91h08@375           -------------------------KFFREIYQDADEDTRR---------A
TraitMillCDS_25598_CDS6534_69_           -------------------------KFFRDIYKDADEDTRR---------A
SGT1_from_Pepper__KOGENT2_               -------------------------KFFRDIYKDADEDTRR---------A
S.lycopersicum_TC192025#1                -------------------------KFFRDIYQDADEDTRR---------A
S.lycopersicum_NP9243669#1               -------------------------KFFRDIYKDADEDTRR---------A
P.trichocarpa_scaff_IV.839#1             ---------------------------------------------------
P.trichocarpa_scaff_44.273#1             -------------------------KFFREIYQDADEDTRR---------A
S.lycopersicum_AW398985#1                ---------------------------------------------------
H.vulgare_c62589592hv270303@64           LKDAEKCIELDPTFSKGYTRKGAVQFFMKEYEKAMETYQAGLKLDPNNQE A.thaliana_AT4G23570.1#1                 MSKSFVESNGTVLSTNWQEVGTKTIESTPPDGMELKKWEI----------
A.thaliana_AT4G23570.2#1                 MSKSFVESNGTVLSTNWQEVGTKTIESTPPDGMELKKWEI----------
A.thaliana_AT4G23570.3#1                 MSKSFVESNGTVLSTNWQEVGTKTIESTPPDGMELKKWEI----------
A.thaliana_AT4G11260.1#1                 MNKSFAESNGTVLSTNWKEVGTKKVESTPPDGMELKKWEY----------
B.napus_BN06MC26625_51284379@2           MNKSFAESNGTVLSTNWKEVGTKKVESTPPDGMELKKWEY----------
Z.mays_ZM07MC27211_BFb0187N13@           MDKSFRESNGTVLSTNWKDVGSKTVEASPPDGMELKKWEI----------
Z.mays_ZM07MC23831_BFb0038K08@           MMKSFVESNGTVLSTNWKDVGAKKVEGSPPDGMELKKWEY----------
O.sativa_LOC_Os01g43540.1#1              MMKSFVESNGTVLSTNWKDVGSKKVEGSPPDGMELKKWEY----------
T.aestivum_TC280790#1                    MMKSFVESNGTVLSTNWKDVGKKTVEGSPPDGMELKKWEY----------
M.truncatula_CT025844_7.4#1              MSKSFLESNGTVLSTDWKEVGSKKVEGSPPEGMEVKKWEY----------
G.max_GM06MC38560_sab91h08@375           MKKSFVESNGTVLSTNWKEVGSKKVEGSAPDGMELKKWEY----------
TraitMillCDS_25598_CDS6534_69_           MMKSFVESNGTVLSTNWKKVGTKKVEGSPPDGMELKKWEI----------
SGT1_from_Pepper__KOGENT2_               MMKSFVESNGTVLSTNWKKVGTKKVEGSPPDGMELKKWEY----------
S.lycopersicum_TC192025#1                MMKSFVESNGTVLSTNWKEVGTKKVEGSPPDGMELKKWEI----------
S.lycopersicum_NP9243669#1               MMKSFVESNGTVLSTNWKEVGAKKVEGSPPDGMELKKWEI----------
P.trichocarpa_scaff_IV.839#1             ---------------------------------------------------
P.trichocarpa_scaff_44.273#1             MKKSFVESNGTVLSTNWKEVGTKKVEGSPPDGMEMRKWEY----------
S.lycopersicum_AW398985#1                ---------------------------------------------------
H.vulgare_c62589592hv270303@64           LLDGIRRCVQQINKANRGDISQEDLQEKQSKAMQDPEIQNILTDPIMRQV A.thaliana_AT4G23570.1#1                 ---------------------------------------
A.thaliana_AT4G23570.2#1                 ---------------------------------------
A.thaliana_AT4G23570.3#1                 ---------------------------------------
A.thaliana_AT4G11260.1#1                 ---------------------------------------
B.napus_BN06MC26625_51284379@2           ---------------------------------------
Z.mays_ZM07MC27211_BFb0187N13@           ---------------------------------------
Z.mays_ZM07MC23831_BFb0038K08@           ---------------------------------------
O.sativa_LOC_Os01g43540.1#1              ---------------------------------------
T.aestivum_TC280790#1                    ---------------------------------------
M.truncatula_CT025844_7.4#1              ---------------------------------------
G.max_GM06MC38560_sab91h08@375           ---------------------------------------
TraitMillCDS_25598_CDS6534_69_           ---------------------------------------
SGT1_from_Pepper__KOGENT2_               ---------------------------------------
S.lycopersicum_TC192025#1                ---------------------------------------
S.lycopersicum_NP9243669#1               ---------------------------------------
P.trichocarpa_scaff_IV.839#1             ---------------------------------------
P.trichocarpa_scaff_44.273#1             ---------------------------------------
S.lycopersicum_AW398985#1                ---------------------------------------
H.vulgare_c62589592hv270303@64           LMDFQENPRAAQDHLKDPGVAQKIQKLINAGIVQTR
```

FIGURE 1 (continued)

```
CLUSTAL W (1.81) multiple sequence alignment gi|218440518|ref|YP_002378847.    --MNIYLPIKRLRGWFKARRFGRSSVDTRYAMLEACLIGILSAVAALVLK
gi|196258397|ref|ZP_03156931.1    --MNLPFPLKRLHGWFKARRFGRSSVDTRYAMLESCLIGILSAIAALLLK
gi|126659209|ref|ZP_01730347.1    -------MPRRFYQWLKSRKLAFNATDTRYALVEASLIGVLSAIAALILK
gi|172034995|ref|YP_001801496.    --MQPHLMPQRLYQWFKSRNFALNATDTRYALVEASLIGVLSAIAALILK
gi|67923321|ref|ZP_00516804.1|    --MGPHLIFQRFYRWLKSRLRTVDATDTRYALAEACLIGILSAIAALILK
gi|218248189|ref|YP_002373560.    --MKPHLIVKRLYQWVKSSHLGVNATDSRYAFVEACLLGLLSGIAALILK
gi|159026894|emb|CAO89145.1|_e    --MGLFARYQNLRQWFKSQHFGRSATDSRYALLVACLIGILSALAAIILK
gi|166366612|ref|YP_001658885.    --MGLFARHQNLRQWFKSQHFGRSATDSRYALLVACLIGILSALAAIILK
gi|16331172|ref|NP_441900.1|_c    --MAWFPFWQRWQQWLRSRHYGRTAIDSRYAIAEACVIGFVSALAALVIK
gi|170077188|ref|YP_001733826.    ----------MRNWWIFRSLGQHSLNNNYLLIEACLIGVISGLAAFLK
gi|158334130|ref|YP_001515302.    ----------MKLISAFQPLRHLTQSSRFAIIEACLIGLISGLAAVALQ
gi|119510301|ref|ZP_01629437.1    ----------MAISGLTQRFRLWLQPTRGLAIAEACIIGLVAALSAVFLK
gi|186682049|ref|YP_001865245.    ----------------MNQRFRTWWQPRRGLAIAEACVIGLVAALSAVFLK
gi|75908381|ref|YP_322677.1|_C    ----------------MYFRSWLQPRRGLAIAEACVIGVLAALSAVFLK
gi|17232383|ref|NP_488931.1|_h    ----------------MYFRSWLQPRRGLAIAEACVIGVLAALSAVFLK
gi|225516217|ref|ZP_03763190.1    ---------------MSKARGLRLPFWSMGYANAEASMIGIVAALSAVLLK
gi|254413597|ref|ZP_05027367.1    ---------------MINPIRQWLLPKRRLAIAEACLIGVVSALSAVLLQ
gi|186683293|ref|YP_001866489.    --------MLARGKILWLRLSRQLVQPRRLAFVEACLIGLVSGLAAVLLG
gi|225522175|ref|ZP_03768989.1    --------MLARSKIFWLRLSRQLVKPRRLAFVEACVIGLVSGLAAVLLG
gi|186682226|ref|YP_001865422.    --------MLARGKILWLRLSRQLLRPRRLAFVEACIIGLVSGLAAVLLG
gi|220909579|ref|YP_002484890.    ----------MGSLAALRRLQQLLRPRRVAVLEACFIGLVSALAAGGMA
gi|37523751|ref|NP_927128.1|_c    -------------MQSWLQNFRQLLRPQRLATLEACLIGLVAGLAAVILK
gi|119486852|ref|ZP_01620827.1    MLRISIPEQLSKRFKIIATQILQPQSQRRLAILEACMIGLVSGLAAFCLR
gi|209525724|ref|ZP_03274261.1    ----MYWPSLTNQFQSLAKSIIG--GSQRLAILEAGLIGLISGIAAFFLR
gi|220908306|ref|YP_002483617.    -------MALMKGTIWLTQSLQRLLRPKSVAILEACAIGLVSALAAVLLK
gi|81300397|ref|YP_400605.1|_C    --------------MFRLRFPPRFAKAQQWAVLEACAIGLVSGASAFLLK
                                                 :  :*.::. :*  :

gi|218440518|ref|YP_002378847.    QGVGWLGGWRLS--LTRTFGALWILPLGGLILGLLAGWVIEILSPAAAGG
gi|196258397|ref|ZP_03156931.1    QGVGWLGGWRVH--ITTKLGAVWLLPLGGLLLGLLAGQLIQVISPAAAGG
gi|126659209|ref|ZP_01730347.1    QGVGWLGGWRVA--LANQFGAMWVLPLGGLILGYLSGLIIETFSPTATGG
gi|172034995|ref|YP_001801496.    QGVGWLGGWRVA--LANEFGGIVVLPLGGLILGYLAGWIIETLSPTATGG
gi|67923321|ref|ZP_00516804.1|    QGVGWLGGKRVA--LANQFGAIWVLPLGGLILGSMAGWLIETLSPTATGG
gi|218248189|ref|YP_002373560.    EGVGWLGGWRVS--LANQLGAIWVLPLGGLFLGSMAGWLIEQTSPTAAGG
gi|159026894|emb|CAO89145.1|_e    LGIGWLGGWRVH--LVANSSPFLVLPLGGFLLGYSAGWIVEHFSPAAAGG
gi|166366612|ref|YP_001658885.    LGIGWLGGWRVH--LVANSSPFLVLPLGGFLLGYSAGWIVEHFSPAAAGG
gi|16331172|ref|NP_441900.1|_c    NGVNWLGSSRLS--LADTYGAIWVLPCFGLVFGGLAGALIEQFSRPAGGG
gi|170077188|ref|YP_001733826.    QGIGFVGGYRVI--LSRQYGAWLILPLFGVVCGWLAGYLLETFAPEAKGG
gi|158334130|ref|YP_001515302.    DGIGWLGGLRIS--LANQFHSPLILPLIGVIGGLIAGLLIETIAPDAKGS
gi|119510301|ref|ZP_01629437.1    FGSGFLGTWRVQ--TSQIVPALLVLPTIGLSFGFIAGSLVNRFAPEASGS
gi|186682049|ref|YP_001865245.    VGSGWLGTWRVH--TTHLFPAWLVLPVIGLVLGFIAGWLVDRLAPEAYGS
gi|75908381|ref|YP_322677.1|_C    VCSGLLGAWRVH--SSHVLPAWVVLPIIGLGFGYLAGLMVQRLAPEAAGS
gi|17232383|ref|NP_488931.1|_h    VCSGLLGAWRVH--SSHILPAWVVLPIIGLSFGYLAGLMVQRLAPEAAGS
gi|225516217|ref|ZP_03763190.1    QGSGCLGTWRVH--STQFVPAWLILPLIGMSFGFLAGWLVQRLAPEAAGS
gi|254413597|ref|ZP_05027367.1    HSIGWLGSWRVQ--TSEQFPPFLVLPAFGLVGALSGFLVEYLAPDASGS
gi|186683293|ref|YP_001866489.    QAVDWAGAWRVH--LSYHWSAYLVLPGIGLAGGLLAGWLVEHFAPEASGS
gi|225522175|ref|ZP_03768989.1    QAVDWAGALRVR--VSYHCPAYLVLPSIGLVGGILAGWLVECFAPEASGS
gi|186682226|ref|YP_001865422.    QAVDWAGAWRVH--LSYIWPAYLVLPGIGLVGGILAGWLVERFAPEASGS
gi|220909579|ref|YP_002484890.    WGVGWMGTWRVN--LAEQWPDWLVLPLFGAIGALLSGALVLREAPEAAGS
gi|37523751|ref|NP_927128.1|_c    QGADLLSHWRLD--AAGSFG-WWVLPLLGLLGGVTAGWLVERFAPEASGS
gi|119486852|ref|ZP_01620827.1    VGAGWLGSWRIYGALNSPLPVWVFLPSVGLIGGFLTGFLVERFAPETTGS
gi|209525724|ref|ZP_03274261.1    TGAGWLGSWRVQGSAH--FSAWLFLPILGVVGGLLSGFLVERIAPEAAGS
gi|220908306|ref|YP_002483617.    QAIAAMESWTAA--IGADLPPLLILPVIGLLGGLLSGWLIEWAAPEATGS
gi|81300397|ref|YP_400605.1|_C    LGATGVQDLRDR-----PGLPLGLQLLLPPILGAIAGWLVQRFAPEAEGS
                                                     .   .:*  ::    :  : *.
```

FIGURE 5

```
gi|218440518|ref|YP_002378847.    GIPQVKAALARFPVPLSLRVALAKLIGAILVLGAGLTLGRRAPTVHIGAA
gi|196258397|ref|ZP_03156931.1    GIPQVKAALARFPVPLSLRVAIAKLLGATLVLGAGLTLGRRAPTVHIGAA
gi|126659209|ref|ZP_01730347.1    GITQVKAALARYPVPLSLRVAVVKLIGTILVLGGGLTLGRRAPTVHIGAA
gi|172034995|ref|YP_001801496.    GITQVKAALARYPVPLSLRVAIVKLIGTILVLGGGLTLGRRAPTVHIGAA
gi|67923321|ref|ZP_00516804.1|    GMTQVKAALARYPVPLSLRVALVKLIGTILVLGGGLTLGRRAPTVHIGAA
gi|218248189|ref|YP_002373560.    GITQVKAALARYPVPLSLRVAVVKLIGTILVLGGGLTLGRRAPTVHVGAA
gi|159026894|emb|CAO89145.1|_e    GIPQVKAALAKYPLPLSWRVAVVKMIGAILILGGGLTLGRRAPTVHIGAA
gi|166366612|ref|YP_001658885.    GIPQVKAALAKYPLPLSWRVALVKMIGAILILGGGLTLGRRAPTVHIGAA
gi|16331172|ref|NP_441900.1|_c    GIPQVKAALARYPIPLDWRVAVVKLLGTVLVLGGGMTLGRRAPTVHIGAA
gi|170077188|ref|YP_001733826.    GVPQVKVLAQFPLPLNWKVALAKSIGTILVLGGGLTLGRRGPSVHIGAA
gi|158334130|ref|YP_001515302.    GIPQVKAALAQFPIALNWQVALVKLFSGITALGTGLPLGRQGPTVQLGAA
gi|119510301|ref|ZP_01629437.1    GIPQVKATLANVPITLSWRVATVKLISAIITLGSGMALGRQGPTVHVGAG
gi|186682049|ref|YP_001865245.    GIPQVKASLANVPVNLSWRVAGVKLLSAIIAIGSGMTLGRQGPTVQVGAG
gi|75908381|ref|YP_322677.1|_C    GIPQVKATLANIPMKLSWRVAVIKLLSAIIALGSGITLGRQGPTVQVGAG
gi|17232383|ref|NP_488931.1|_h    GIPQVKATLANIPMKLSWRVAIVKLLSAILALGSGLTLGRQGPTVQVGAG
gi|225516217|ref|ZP_03763190.1    GIPQVKASLANIPIKLSWRVEGIKLLSTIISLGSGITLGRQGPTVQIGAS
gi|254413597|ref|ZP_05027367.1    GIPQIKAALGGYPIALDLRVALVKLVSSILAIAAGLTLGRQGPTVHIGAA
gi|186683293|ref|YP_001866489.    GMSEVKAVLARVPMPLNLRIALVKLIGATLVLGSGMPLGREGPTVQIGAA
gi|225522175|ref|ZP_03768989.1    GMSEVKAVLARVPMPLNLRIALVKLISATLVLGSGMPLGREGPTVQIGAA
gi|186682226|ref|YP_001865422.    GMSEVKAVLARVPMPLNLRIALVKLVLVLGSGMPLGREGPTVQIGAA
gi|220909579|ref|YP_002484890.    GMSQVKAVLARVPMPLNLRIALVKLISAVLALGSGLALGREGPTVQVGAA
gi|37523751|ref|NP_927128.1|_c    GIPQVKAVLARVPMALDLRVALVKLVGTMVTLGSGFPLGREGPTIQIGAA
gi|119486852|ref|ZP_01620827.1    GVPQVKAALSGMPISLDFRVAISKLLGTMFTMGSGLTLGRQGPTVQIGAA
gi|209525724|ref|ZP_03274261.1    GIPQVKAALGGIKTSLDLRVAVVKLISTMITMASGFTLGRQGPTVQIGAA
gi|220908306|ref|YP_002483617.    GIPQVKAALGYASIALDLRVAVVKLVSTTLALGAGLALGRQGPTVQIGAA
gi|81300397|ref|YP_400605.1|_C    GISQVQAALSGSRIALNLRVAIVKIASTMLVVGSGLPLGRQGPTVQVGAS
                                  *:.::. *.          *. ::    *  .     :. *:.***..*::::**.

gi|218440518|ref|YP_002378847.    LAAQLSQWLPTSPEHRRQMIAAGAASGLAAGFGTPIAGVLFVIEELMRDV
gi|196258397|ref|ZP_03156931.1    LAAQLSQWVPTSPEHRRQMIAAGAASGLAAGFGTPIAGVLFVVEELMRDV
gi|126659209|ref|ZP_01730347.1    LAAQLSNWVPTSPEHRRQMIAAGAAAGLAAGFTTPIAGVLFVIEELMRDV
gi|172034995|ref|YP_001801496.    LAAQLSSWVPTSPEHRRQMIAAGAAAGLAAGFTTPIAGVLFVIEELMRDV
gi|67923321|ref|ZP_00516804.1|    LAAQLSSWVPTSPEHRRQMIAAGAAAGLAAGFTTPIAGVLFVIEELMRDV
gi|218248189|ref|YP_002373560.    LAAQLSSWVPTSPEHRRQMIAAGAAAGLAAGFGTPIAGVLFVVEELMRDV
gi|159026894|emb|CAO89145.1|_e    LAAQLSVWLPTSPDHRRQMIAAGAAAGLAAGFTTPIAGVLFVIEELMRDV
gi|166366612|ref|YP_001658885.    LAAQLSVWLPTSPDHRRQMIAAGAAAGLAAGFTTPIAGVLFVIEELMRDV
gi|16331172|ref|NP_441900.1|_c    LAAQLSRWFPTSPEHRRQMIAAGAAAGLAAGFTTPIAGVLFVVEELMRDV
gi|170077188|ref|YP_001733826.    LAAQLSQWLPTTPNHRRQMIAAGAAAGLAAGFNTPIAGVLFVVEELMRDM
gi|158334130|ref|YP_001515302.    LAAQLSYWFPTAPNHRQQMIAAGAGAGLAAGFAAPIAGVLFIVEELLHDL
gi|119510301|ref|ZP_01629437.1    LAAGMSRWVPTSPDHRRQMIAAGAGAGLAAAFNAPITGVLFIVEELLQDL
gi|186682049|ref|YP_001865245.    LAAGMSRWVPTSPDHRRQMIAAGAGAGLAAAFNAPIAGVLFIVEELLQDL
gi|75908381|ref|YP_322677.1|_C    LASGMSRLVPTSPDHRRQMIAAGAGAGLAAAFNAPIAGVLFIIEELLQDL
gi|17232383|ref|NP_488931.1|_h    LAAGMSRLVPTSPDHRRQMIAAGAGAGLAAAFNAPIAGVLFIIEELLQDL
gi|225516217|ref|ZP_03763190.1    LAAGMSRTFPTSPEHRRQMIAAGAGAGLSAAFNAPIAGVLFIIEELLQDL
gi|254413597|ref|ZP_05027367.1    LAAQFSRWFPTSPSHRRQLIAAGSAAGLAAGFNTPIAGILFVVEELIHDF
gi|186683293|ref|YP_001866489.    LANQLSNWAPTSPEHRRQLIAAGAGAGLAAAFNAPIAGVLFVVEELLQDV
gi|225522175|ref|ZP_03768989.1    LANQFSNWAPTSPEHRRQLIAAGAGAGLAAAFNAPIAGVLFVVEELLQDV
gi|186682226|ref|YP_001865422.    LANQLSNWVPTSPEHRRQLIAAGAGAGLAAAFNAPIAGVLFVVEELLQDV
gi|220909579|ref|YP_002484890.    LAAQLSHWLPTSPEHRRQLIAAGAGAGLAAAFNAPISGVLFVAEELMQDV
gi|37523751|ref|NP_927128.1|_c    LANQLSRWVPTSPAYRRQLVAAGAGAGLAAAFDAPIAGVIFVVEQLLQNV
gi|119486852|ref|ZP_01620827.1    LAAWIGRWVPTSPNYSRQIIACGAAAGLAAGFNAPIAGVLFVVEDLLHDI
gi|209525724|ref|ZP_03274261.1    LAAWVSRWVPTSPNYRKQLIACGAAAGLAAGFNAPIAGVLFVVEDLLHDI
gi|220908306|ref|YP_002483617.    LAGQFSRWLATSPAYQRQLIAAGAAAGLAAGFNAPIAGVLFVIEELLQDL
gi|81300397|ref|YP_400605.1|_C    LAGQMSQWFPTSPDYRRQLIASGAAAGLAAGFNAPLAGVMLVLEQLLHDV
                                  **    ..    .*:*  :  :*::.*.*::.**:*.*  :*:::*:::: *:*:::.
```

FIGURE 5 (continued)

```
gi|218440518|ref|YP_002378847.    SGLTLETAIIASFTGAVVSLLLESTGP--------IIPAPLN-ITFSARE
gi|196258397|ref|ZP_03156931.1    SGLTLETAIVASFTGAVVSLLLESAGP--------IIPAPLN-INFSARE
gi|126659209|ref|ZP_01730347.1    SGLTLETAIVASFTGAVVSLILQSSTLNFPS----SLLELPD-ITFSISD
gi|172034995|ref|YP_001801496.    SGLTLETAIVASFTGAVVSLILQSSTLNLPS----SLLELPD-ITFSALD
gi|67923321|ref|ZP_00516804.1|    SGLTLETAIVASFTGAVVSQILQSSTFNFPS----SLLDLPD-IAFSASE
gi|218248189|ref|YP_002373560.    SGLTLQTSIIASFTGAVVSLIVEARSLSFAP-----LLNLPN-ISFSVDD
gi|159026894|emb|CAO89145.1|_e    SSMTLETAIVASFTGAVVSMMLQNTPS--------IITEYAN-ISFSAQE
gi|166366612|ref|YP_001658885.    SSMTLETAIVASFTGAVVSMMLQNTPS--------IITEYAN-ISFSAQE
gi|16331172|ref|NP_441900.1|_c    SSLTLETAIVASFVGAVTSLVFQSSDLNLAH----SLSNSPT-VRFTTGE
gi|170077188|ref|YP_001733826.    SGLTLETAIVASFTGAVVSRWFGTSDLNLPA----ELLNAANQSNFYLAE
gi|158334130|ref|YP_001515302.    SGLTLGTAILSSFIGAVVAHVLGGQNLSISF----EQVTTAT--SFSVPE
gi|119510301|ref|ZP_01629437.1    SGLTLGTAIIASFIGGVVSRLLGGGSLQLNL----ELLQYAS--NFTLPE
gi|186682049|ref|YP_001865245.    SGLTLGTAIIASFIGGVISRLLGGGSFDLNL----QLTQSSS--QFSIPE
gi|75908381|ref|YP_322677.1|_C    SGLTLGTAIIASFIGGVVSRLLGGRSLNLNI----ELLSYSS--RFTFPE
gi|17232383|ref|NP_488931.1|_h    SGLTLGTAIIASFIGGVVSRLLGGRSLNLNI----ELLSYSS--GFSFPE
gi|225516217|ref|ZP_03763190.1    SGLTLGTAIIACFIGGVVSRLLGGGSLQLNL----QSMEYFS--SFSLLE
gi|254413597|ref|ZP_05027367.1    SGLTLGTAILASFIGAVISRILGGRSLDLNL----ELTQTTS--SFSAPE
gi|186683293|ref|YP_001866489.    SGITLGTAILASFIASVISRLYGSHNLDLNH-----LNLGLPDTTFFAQE
gi|225522175|ref|ZP_03768989.1    SGITLGTAILASFIASVISRLYGSHNLDLNH-----LNLGLPDTTFFAQE
gi|186682226|ref|YP_001865422.    SGITLGTAILASFIASVISRLYGSHSLDLNH-----LDLSFSHTTFFAQE
gi|220909579|ref|YP_002484890.    SGGTLGTAILASFIGSSVSRLLGGNSLDVN------LEASKMLTSFTLTE
gi|37523751|ref|NP_927128.1|_c    SGLTLGVAILASFIGAVLSRVLGGFSFDLKS-----SMADFQTG-FTVQE
gi|119486852|ref|ZP_01620827.1    SGITLGPAIIASFIGAVVSRLLEGQNPDFEPPSAEVMERSYQQWLIQPGE
gi|209525724|ref|ZP_03274261.1    SGLTLGPAIIASFTGAVVSRLLGNKAMGLPPTIDIPPEALYQQWLIEPLE
gi|220908306|ref|YP_002483617.    SELTLGTAILAAFVGGVVSRLLGGRGLIPDLSG--------IDLSFTLMD
gi|81300397|ref|YP_400605.1|_C    SSFTLGTAVLAAFIGAVVSGILGSQSLSFSS------EIVAAPAALTVPE
                                  *   **   ::::.*  ..   :                   :    :

gi|218440518|ref|YP_002378847.    IPLYLLLGFLAGILGALFNAGILFCMRVQKQLRLS--IPWRIGLVCMISG
gi|196258397|ref|ZP_03156931.1    IPLYLLLGFLAGMLGALFNWGILFCMNVQKRLRLP--MPWRVGLVCMISG
gi|126659209|ref|ZP_01730347.1    IPFYLLLGILAGLLGALFNRGLLTSVTIQRKFNLP--LSWRIGLMGMVSG
gi|172034995|ref|YP_001801496.    IPFYLLLGILAGVLGALFNRGLLLSVKIQHQFNLP--LSWRIGLMGMVSG
gi|67923321|ref|ZP_00516804.1|    IPFYLLLGILAGILGALFNRGLLLSVKIQKYLNLP--LSWRIGLMGMASG
gi|218248189|ref|YP_002373560.    IPFYLLLGILAGFLGALFKQGLLFSLAIQSRLKLP--LPWRIGLVAMISG
gi|159026894|emb|CAO89145.1|_e    IPIYCLLGVLAGLLGALFNQGILFCSQMQRRWRLS--LAWRIGLVSGLSG
gi|166366612|ref|YP_001658885.    IPIYCLLGVLAGLLGALFNQGILFCSQLQRRWRLS--LAWRIGLVSWLSG
gi|16331172|ref|NP_441900.1|_c    IPFYLLLGILAGILGVLLNRSILSLQNWQRKQNLS--LVIRIGVVGLISG
gi|170077188|ref|YP_001733826.    IPWYLLGGLAGVLGALFNRGLLTVLGFNRRLRLS--LGVRMAIAGAISG
gi|158334130|ref|YP_001515302.    IPFFILLGILAGGFGAIFNRGLLLSVDLNRRLKFLG-LPWRISLAGGICG
gi|119510301|ref|ZP_01629437.1    IPFFVLLGILAGFLGALFNRGLIASIKIYQNLHLS--LPLKMALAGCISG
gi|186682049|ref|YP_001865245.    IPFFVLLGILAGLLGALFNSGLIFSIKFYRRLHIS--LPLRVALAGFISG
gi|75908381|ref|YP_322677.1|_C    IPFFLLLGVLAGLLGALFNRGLIFSLQFYRSLHIS--LPLRVGLAGLVSG
gi|17232383|ref|NP_488931.1|_h    IPFFLLLGVLAGLLGALFNRGLIFSLQFYRNLHIS--LPLRVALAGLVSG
gi|225516217|ref|ZP_03763190.1    IPIFLLLGIFAGLLGAIFNLGLIFSVKTYRGLHIS--LPLRVARTGLFCG
gi|254413597|ref|ZP_05027367.1    IPFYLILGLLAGLLATLFNRGILFSLTLQRRFHVS--LAVKMGLAGLICG
gi|186683293|ref|YP_001866489.    IPFYLILGVLAGLLGILFNKGILKSLAINRRLHVS--LPWRIGIAGLVSG
gi|225522175|ref|ZP_03768989.1    IPFYLILGVLAGFIGILFNKGILESLAINRRMVRLS--LSWRIGIAGLVSG
gi|186682226|ref|YP_001865422.    IPFYLILGVLGGLIGILFNKSILASLAINRRLLNLS--LPWRIGIVGLVTG
gi|220909579|ref|YP_002484890.    IPAYLVLGGLAGLLGAIFDHAVLISLKLNRRYLPLS--LPWRMALAGLITG
gi|37523751|ref|NP_927128.1|_c    IPFYLLLGVMAGVLGALYNRGLIASLTFNRRVLRLN--MPLRVGLAGLVMG
gi|119486852|ref|ZP_01620827.1    IPFYIILGILAGVLGTLFSRSIVSALQFSRKAFSLG--LPVRMALAGFLCG
gi|209525724|ref|ZP_03274261.1    IPFYILVGVLSGVFGVLFSRGIITFQKFNRHTLKLG--LPLSMAVAGLICG
gi|220908306|ref|YP_002483617.    IPVLMLLGAIAGVLGASFNRGILTSLRFYRQYLPGWRPSWQMGLAGAISG
gi|81300397|ref|YP_400605.1|_C    LPVVLLLGLFAGGLGILFNRGLAFSQRCYERLPLKG-LPWRAIASGISA
                                  :*    ::*  :.*  :.    . .:              :.      .
```

FIGURE 5 (continued)

```
gi|218440518|ref|YP_002378847.   AVIAVLPPFFRDNSGLREFLITGELGWRNILLALIAHFFLTILAYSSSAP
gi|196258397|ref|ZP_03156931.1   GVIALLPPFFRDNSGLREFLVTGELGWRSILLAFVAHFCLTILAYSSGAP
gi|126659209|ref|ZP_01730347.1   IIIALLPPFFRDNAGLRIFLVTGELDGSRILLAFVAHFFLTILAYSCNAP
gi|172034995|ref|YP_001801496.   IIIAVLPPFFRDNAGLRIILVTGELDWSRILLAFVAHFFLTILAYSANTP
gi|67923321|ref|ZP_00516804.1|   LIIAILPPFFRDNTGLRIDLVQGELEWSRILLAFVAHFFLTILAYSANTP
gi|218248189|ref|YP_002373560.   LIIALLPPFFQDNTRLQTVLVRGELSTEKIFLAFVAHFFLTMLAYSSNAP
gi|159026894|emb|CAO89145.1|_e   TVVAFLPDFFRDNTGLREFLLAGELSWQNTALAFVVYFFLTMISYSSGAP
gi|166366612|ref|YP_001658885.   TVVAFLPDFFRDNTGLREFLLAGELSWQNTALAFVVYFFLTMISYSSGAP
gi|16331172|ref|NP_441900.1|_c   VAIALLPSFFRDNAGLREFVTSGELSWHQVVLTLVAHFILTILAYSTDAP
gi|170077188|ref|YP_001733826.   TVVAFLPPFFRDNAGLRDFLLTGDAGWQVIAIAFVAHFFLSLIAYGSGAP
gi|158334130|ref|YP_001515302.   SIIGQLPSIFQDNTGLRGLLGLGDLGWQLALTAFVVQFGLTLIAYGSGAP
gi|119510301|ref|ZP_01629437.1   LLVAMLPESFRDYAGLREYMIISEANITFAAIAFLSQFLLTLVAFGSGAP
gi|186682049|ref|YP_001865245.   VVVAMLPESFRDNTGLRESLITGGSHPTVAAIAFTAQFILTLIAFGSGAP
gi|75908381|ref|YP_322677.1|_C   IVVSLLPESFRDNAGLREYVITGDLNPSFAAIAFVAQFTLTLVAFGSGAP
gi|17232383|ref|NP_488931.1|_h   IVVSLLPESFRDNAGLREYVITGDLNPSFAAIAFIAQFILTLVAFGSGAP
gi|225516217|ref|ZP_03763190.1   LIVSALPEYYRDNTGLREYMIASQPNPSFAAITLIAQFILTLIAFGSGAP
gi|254413597|ref|ZP_05027367.1   CVVSLLPPDFRNNRGLRELLITGAESWQFTSLALVTYFFLTLVSYGSGAP
gi|186683293|ref|YP_001866489.   LAIALLPATFRDHAGLREILLAGSANWSFAAIALLVQFILIIFTYGSGAP
gi|225522175|ref|ZP_03768989.1   VVIALLPATFRDHAGLREILLAGNTNWSFAAIALLVQFILIIFTYGSGAP
gi|186682226|ref|YP_001865422.   VAIALLPITFRNNAGLREILLVGSGNWLFAAIALLVQFTLIILTYGSGAP
gi|220909579|ref|YP_002484890.   LLIALLPESFRNYAELKEALLSGQITWAGAALFFVSYFPLILIASGSGAP
gi|37523751|ref|NP_927128.1|_c   GSLALLPAVFRDGEALRGLIIGAQEPWQFAALAFVAQFVLTLIAYGSGAP
gi|119486852|ref|ZP_01620827.1   LIVSVLPEFRNNAGLREFLLSGELNWTITALAFVAHFVLTTIAASSGAP
gi|209525724|ref|ZP_03274261.1   MVIAVLPETFRDNAGLREYILKGNILWTTTALAFVVQFSLTTMAAGSGAP
gi|220908306|ref|YP_002483617.   MILAFLPPILRSSSGTQDLLVLGEIGWQITAIAFVGKFLLVLLAYGSGVP
gi|81300397|ref|YP_400605.1|_C   LLLLLLPAALRQG-LSNPFRVTIPDSGSIALLMLAINFGLTLVAAGSGAS
                                 :  **    :.               :     *   * .:  ...

gi|218440518|ref|YP_002378847.   GGLFAPALVMGSALGYLVGDLGELLTGSG-------AATTYALAGMGGFF
gi|196258397|ref|ZP_03156931.1   GGLFAPALVLGSALGYIVGELAGWVTGSG-------AATTYALAGMGGFF
gi|126659209|ref|ZP_01730347.1   GGLFGPALVLGSALGYLVGDFEQFVTGTG-------AQSSYALAGMGAFF
gi|172034995|ref|YP_001801496.   GGLFGPALVLGSALGYLVGDFEQFLTGTG-------TQSSYALAGMGAFF
gi|67923321|ref|ZP_00516804.1|   GGLFGPALVLGSALGYLVGDFEELLTGTG-------TETTYALAGMGAFF
gi|218248189|ref|YP_002373560.   GGLFAPALVLGSALGYLVGDLEQFIMGSS-------SQSAFALAGMGGFF
gi|159026894|emb|CAO89145.1|_e   GGLLAPALVLGSCLGFLVGGIETKIMGFG-------SEPSYALAGMGAFF
gi|166366612|ref|YP_001658885.   GGLLAPALVLGSCLGFLVGGIETKMMGFG-------SEPSYTLAGMGAFF
gi|16331172|ref|NP_441900.1|_c   GGLFAPALVMGSALGYLVGEFGSYWQDQV-------TQTTFALAGMGAFF
gi|170077188|ref|YP_001733826.   GGLFAPTLVLGTALGYLVGTCAEIFVPEA-------TQYTYALAGMGAFF
gi|158334130|ref|YP_001515302.   GGLFAPSLVMGAALGNLVGLGQAQLLGAG-------LPTTYAFVGMGAFF
gi|119510301|ref|ZP_01629437.1   GGLFAPSLILGSCLGHLVGVSASYFLAVD-------SPTTYALAGMGGFF
gi|186682049|ref|YP_001865245.   GGLFAPSLILGSCLGHIIGVAELYITGVG-------SPTTYALAGMGGFF
gi|75908381|ref|YP_322677.1|_C   GGLFAPSLILGSALGHLVGVLEYQITGDG-------SPVTYALAGMGGFF
gi|17232383|ref|NP_488931.1|_h   GGLFAPSLILGSALGHLVGVLEYQITGDG-------SPVTYALAGMGGFF
gi|225516217|ref|ZP_03763190.1   GGLFAPSLILGSCLGHLVGVCEFQLWGLG-------CPTTYALAGMGGFF
gi|254413597|ref|ZP_05027367.1   GGLFHPSLVLGSALGYLVGVAKLSFLGVG-------EPTTYALAGMGAFF
gi|186683293|ref|YP_001866489.   GGLLVPTLALGAALGYLVGAVEHSLLGMS-------AATVYAHVGMAAFF
gi|225522175|ref|ZP_03768989.1   GGLLVPTLVLGSALGYLVGAIEHSLLGMS-------AAAVYAHVGMAAFF
gi|186682226|ref|YP_001865422.   GGLLVPTLVLGAALGYLVGAAEQSLLGMS-------AATTYAHVGMAALF
gi|220909579|ref|YP_002484890.   GGLLVPTLLLGAMLGCWLGGMQHSFLGLG-------VAVSYARVGMGAFM
gi|37523751|ref|NP_927128.1|_c   GGVFAPSLVLGAALGSLVGTLSYSTLAVN-------APITYSLVGMGAFF
gi|119486852|ref|ZP_01620827.1   GGLFAPSLVLGAALGKLIGIWEFSLIGLE-------PPTTFAYAGMGAFF
gi|209525724|ref|ZP_03274261.1   GGLFAPSLILGAALGNTIGLWEEATIALQ-------PHTTFAFAGMGAFF
gi|220908306|ref|YP_002483617.   GGLFAPSLILGSALGGLIGQMAQGVQLELNGTVLSQAPVIYTLTGMGAFF
gi|81300397|ref|YP_400605.1|_C   GGIFAPALVLGSSLGLGVVLSIQAIFLQVGIPLRIDAPATYALAGMGAMF
                                 **::  *:*  :*: **   :                 ::  .**..::
```

FIGURE 5 (continued)

```
gi|218440518|ref|YP_002378847.    TAVVRAPVTAIVIVFELRANFNIVLPLMITCAVSYLVAENVFSRSIYEHL
gi|196258397|ref|ZP_03156931.1    TAVVRAPVTAIVIVFELKANFNIVLPLMLTCAVSYLVAENVFSRSIYEHL
gi|126659209|ref|ZP_01730347.1    TAVVRVPVTAIVFVFELNTDFNIVLPLMVTCAVSYIVAESVSRGSLYEHM
gi|172034995|ref|YP_001801496.    TAVVRVPVTAIVFVFELNTDFNIVLPLMVTCAVSYIVAESVSRGSLYEHM
gi|67923321|ref|ZP_00516804.1|    TAVVRVPVTAIVFVFELNTNFNIVLPLMVTCAVSYIVAESKGSLYEHM
gi|218248189|ref|YP_002373560.    SAVVGVPVTAIVIVFELNSNFNIVLPLMVTSSVAYVVADSFSRGSLYERM
gi|159026894|emb|CAO89145.1|_e    TGVVRVPVTAIVIVFELHRNFNIVLPLMLTCAVSYITAESIRPGSLYEHL
gi|166366612|ref|YP_001658885.    TGVVRVPVTAIVIVFELHRNFNIVLPLMLTCAVSYITAESIHPGSLYQHL
gi|16331172|ref|NP_441900.1|_c    TSVVRVPVTAIIIVFELTGNFNVVLPLMVACATSYLVAESLFPRSLYDHL
gi|170077188|ref|YP_001733826.    TGVARVPVTAIVIVFELTTDFNLVLPLMLASVTALIVAESIFKGSIYEYL
gi|158334130|ref|YP_001515302.    GAVSRVPVTAIVIIFEITQDFNLVLPLMISSVVAYLTAEQINQSSIYDLL
gi|119510301|ref|ZP_01629437.1    SAVSKVPITAIVIVFEMTTDFNLVLPLMIVSVAAYLVSDKVMPGSLYDKL
gi|186682049|ref|YP_001865245.    SAVSKVPITAIVIVFEMTTDFNLVLPLMIVSVAAYLVADKVVSGSLYEKL
gi|75908381|ref|YP_322677.1|_C    SAVSKVPITAIVIIFEMTTDFNLVLPLMIVSVTAYLVADKVVPGSLYEKL
gi|17232383|ref|NP_488931.1|_h    SAVSKVPITAIVIVFEMTTDFNLVLPLMIVSVTAYLVADKVVPGSLYEKL
gi|225516217|ref|ZP_03763190.1    SAVSKVPITAIVIVFEMTTDFNLVLPLMIVSVISYLVADQLVPGSLYDKL
gi|254413597|ref|ZP_05027367.1    SAVSKVPITAIVIIFEITADFNLVLPLMITCVVSYLIADQLSKGSLYQRL
gi|186683293|ref|YP_001866489.    SAVSKVPITAVVIVFEMTTDFNLVLPLMIASVVAYLVAEKIDHRSLYDLL
gi|225522175|ref|ZP_03768989.1    SAVSKVPITAVVIVFEMTTDFNLVLPLMIASVVAYLVAEKIDHRSLYDLL
gi|186682226|ref|YP_001865422.    SAVSKVPITAVVIVFEMTTDFNLVLPLMIVSVIAYLVAEKIDPRSLYDLL
gi|220909579|ref|YP_002484890.    AATAKAPVTAIVIVFELTHDFNLVLPLMIASVIAYLVSERLFPGSFYDRI
gi|37523751|ref|NP_927128.1|_c    CAVTRVPITAVIIIFEITNDFNLVLPLMVVCVVASLVAERLNEGSIYDQL
gi|119486852|ref|ZP_01620827.1    CAVSRTPITAVVIVFEITRDFNLVLQLMICSVVAYFVADKIDKHSLYDRL
gi|209525724|ref|ZP_03274261.1    CAVSRTPVTAVVIVFEITTNFNLVLPLMICSVVSYLVAEKIEKDSLYDRL
gi|220908306|ref|YP_002483617.    SAVTRGPITAIVIVFELTMDFDVVLPLMIGSVVAYLVAEKVSKGSIYTHL
gi|81300397|ref|YP_400605.1|_C    SAVTQGPITAIVIVFEMTRDFNAVLPLMVASITAYGIASLARSPSKAAAV
                                  ..  *:*.::::**:  :*: ** **:. :   :.    *    :

gi|218440518|ref|YP_002378847.    LDASGIHLT-EEIPVNDFLSKLKASDVMQSQVETLDSYLSLEAVLQAMSI
gi|196258397|ref|ZP_03156931.1    LDASGIHLS-EEVPVNDFLSKLKAADVMQSQVESLESHLTLDKVLQAMSI
gi|126659209|ref|ZP_01730347.1    LHARGIYIN-EAATGQDFLSKLTASQVMESQVETLSSDLTLDEVLQAMSN
gi|172034995|ref|YP_001801496.    LHARGIYIN-EAATGQDFLSKLTASQVMESHVETLSSDLSLDEVLQAMSN
gi|67923321|ref|ZP_00516804.1|    LKARGIYIN-EGATGQDFLSKLTASEVMQSQVETLSSDFTLDDVLQAMSA
gi|218248189|ref|YP_002373560.    LKARGIYLD-NNPVVQDFLSQLTAADVMQSQVETLPSDLTLDQVIQAMSL
gi|159026894|emb|CAO89145.1|_e    LSASGIILN-EETPANDVLAHLSAMDVMQSQVEILAADLPLGEVVKIMSR
gi|166366612|ref|YP_001658885.    LSASGIILN-EETPSNDVLAHLSAMDVMQSQVEILPADLPLGEVVKIMSR
gi|16331172|ref|NP_441900.1|_c    LETKGIFLA-EEKPDHDFLADIRAGQVMKTEVESLEQSLTLAQVLPIMSN
gi|170077188|ref|YP_001733826.    LEASGIHLE-EEKNPQ-VLTDLTAAQVMQPEVETLESHLNLKDLVPILSE
gi|158334130|ref|YP_001515302.    LQQQGIQLQNASPSAQRMLDALTAEDIMQRQVETLPSDLSLDAARKIFSR
gi|119510301|ref|ZP_01629437.1    LQLKGITITKAVSPEG-ILTKLTANDVMQHRVETLDADMTLEEAMQVFSR
gi|186682049|ref|YP_001865245.    LELKGITLKQVPMEG-ALTKLTAKDVMQERVETLDAEMSLEEAMQSFAR
gi|75908381|ref|YP_322677.1|_C    LLLNGITLTKQMSVEG-ILSQMTAKDVMQQRVETLDADITLEEAKQAFAS
gi|17232383|ref|NP_488931.1|_h    LLLNGITLTKQMSVEG-ILSQMTAKDVMQQRVETLDAEITLEEAKQAFAS
gi|225516217|ref|ZP_03763190.1    LLLN--GIKKDATREG-VLTQLTAQDVMQERVETLETQMSVDEVIQAFSR
gi|254413597|ref|ZP_05027367.1    LEWRGYTSPTQKVDKG-SLVGLTAEDLMQRQVETLSLHMTLDDALQMVSR
gi|186683293|ref|YP_001866489.    LEWKGIHITKEPST-EGLLAQLSALDVMQRRVETLSSQMSTDEAVQAFSH
gi|225522175|ref|ZP_03768989.1    LEWKGIHITKEPSR-EVLLAQLSAVDVMQRRVETLSSQMSTDEAVQAFSH
gi|186682226|ref|YP_001865422.    LEWKGIHITKEPGT-EGILAQISAADVMQRRVETLSSQMSIDEAVQAFSD
gi|220909579|ref|YP_002484890.    LELNGIYLNELTTV-NTSLADMTAAQVMQRQVETLRSDMPLEEAVQAFSR
gi|37523751|ref|NP_927128.1|_c    LAWNGIRLGEEAVSDEKLLAQLAAGDVMQTRLETLESTLPLSEVSQAFSR
gi|119486852|ref|ZP_01620827.1    LKLNGIELKEDQ-LDREALSKLLARDVMQRQVETLSSQLPLLQVRQEFSR
gi|209525724|ref|ZP_03274261.1    LALSGIELEPDQNADRVALNMLHARDVMQRQVETLEDQLSLEQVRSAFSQ
gi|220908306|ref|YP_002483617.    LELRGIQLDQKFAGDQ-QLQGLLAADIMQRRVETLPADMTIAAAIQFFEQ
gi|81300397|ref|YP_400605.1|_C    VDALPTLNS---------SLGLTAAQVMASPVETLEASLPLTEVIQQFNR
                                  :        * ::*     :* * :             .
```

FIGURE 5 (continued)

```
gi|218440518|ref|YP_002378847.     SRHRGFPVVEEGKLVGIVTQSDLSNLGDR----------SEELTLRQIMT
gi|196258397|ref|ZP_03156931.1     SRHRGFPVVEAGKLVGIVTQSDLSNLGER----------SPDVSLREIMT
gi|126659209|ref|ZP_01730347.1     SSHRGFPVVEQGQLVGIVTQTDLAKLKKE----------PGYTPLQEFMT
gi|172034995|ref|YP_001801496.     STHRGFPVVEQGQLVGIVTQTDLAKLKKV----------PGYTPLSEFMT
gi|67923321|ref|ZP_00516804.1|     SSHRGFPVLAEGGLVGIVTQTDLAKLKKV----------PGYTPLWEFMT
gi|218248189|ref|YP_002373560.     SSHRGFPVMEEGKLVGIVTQTDVANAAKL----------SSQTPVKQFMT
gi|159026894|emb|CAO89145.1|_e     SHHRGFPVVEQGRLLGIFTQSDLDKWRSK----------NSQTVLREMMT
gi|166366612|ref|YP_001658885.     SHHRGFPVVEQGRLLGIFTQSDLDKWRSK----------NSQTVLREIMT
gi|16331172|ref|NP_441900.1|_c     SHHRGFPVVQGGKLVGVFTQTDLANAAQE----------SVHIALKQIMT
gi|170077188|ref|YP_001733826.     SPHRGFPVLKQGKLVGIVTQGDLAQMAAQ----------GKNLTVAQVMQ
gi|158334130|ref|YP_001515302.     SHHRGFPVLEDRRLVGILSRTDLNRVTQQQK--------PGDTLIRDIMT
gi|119510301|ref|ZP_01629437.1     SHHRGFPVVENGKLIGIITQSDFVTKRDSDSYILSNSQSPKDVSLREIMI
gi|186682049|ref|YP_001865245.     SHHRGFPVVEDSKLVGIVTQSDLLKIRESTNHTFRD-RNLADIFLKEIMT
gi|75908381|ref|YP_322677.1|_C     SHHRGFPVVEDNKLVGIITQSDLTKSLSRN---------LENHPHLREIMT
gi|17232383|ref|NP_488931.1|_h     SHHRGFPVVEDNKLVGIITQSDLTKSLSRS---------LENNPHLREIMT
gi|225516217|ref|ZP_03763190.1     SHHRGFPVVENCKLVGVVTESDLQKIPVSR----------DTPLREIMR
gi|254413597|ref|ZP_05027367.1     STHQGFPVVDEGTLVGIISQSDLTQATKMQGNPPR-CPFPGTTPLAEIMT
gi|186683293|ref|YP_001866489.     SHHRNFPVLENGKVVGIVTQKNLVNIASEQ--------LGKDTTIGEIMT
gi|225522175|ref|ZP_03768989.1     SHHRNFPVLENGKVVGIVTQEDLVNIASQK--------LSGDTTISEIMT
gi|186682226|ref|YP_001865422.     SHHRNFPILEKGKVVGIVTQKDLVNLASQQ--------LSGNTTISQIMT
gi|220909579|ref|YP_002484890.     SHHRGFPVLEEDKLVGIVTQTDLNTIKQRP--------LPPNTPLQQIMT
gi|37523751|ref|NP_927128.1|_c     SHHRGFPVVKDEKLVGIVTQTDLMKIAARN--------LPPTAPLSELMT
gi|119486852|ref|ZP_01620827.1     SQHRGFPVVENGKLVGIVTQRDLSNVSQQN--------LPEDTPLHKFMT
gi|209525724|ref|ZP_03274261.1     SHHRGFPVVNQGKLVGIISQTDMAKINQQD--------ISEQTPLHKLMT
gi|220908306|ref|YP_002483617.     SHHRGFPVVADGRLVGMVTQSDLARVSVRG--------LSPDLPLSQIMT
gi|81300397|ref|YP_400605.1|_C     THHRGFPVTQKGALVGIVTSSDLDEQTLKGK--------GESVRLSEIMT
                                    : *:.**:          ::*:.:   :.                : ..* gi|218440518|ref|YP_002378847.     PKPITVQPETSLSDVLYLLNRYQLSRLPVTEG-HKLVGIITRTDIIQAEV
gi|196258397|ref|ZP_03156931.1     PKPITVQPETSLSDVLYLLNRYQLSRLPVTEG-HILVGIITRTDIIQAEV
gi|126659209|ref|ZP_01730347.1     RRPITVQAEASLSDVLYLLNRYQLSRLPVTEG-HKLVGIITRTDIIRVEA
gi|172034995|ref|YP_001801496.     RRPITVQAESSLSDVLYLLNRYQLSRLPVTEG-HKLVGIITRTDIIRIEA
gi|67923321|ref|ZP_00516804.1|     RKPITVQAEASLSDVLYLLNRYQLSRLPVTEG-HKLVGIITRTDIIRIEA
gi|218248189|ref|YP_002373560.     PRPISVEADALLSDVLYLLNRYQLSRLPVTEG-SKLVGIITRTDIIRVEA
gi|159026894|emb|CAO89145.1|_e     PNPITVAPQAALSDVLFLLNRYQLSRLPVTDG-QKLVGIITRTDIIRVEA
gi|166366612|ref|YP_001658885.     PNPITVAPQAALTDVLFLLNRYQLSRLPVTDG-QKLVGIITRTDIIRVEA
gi|16331172|ref|NP_441900.1|_c     PNPITVDPEAPLSDVLYLLNRYQLSRLPVVEGDNKLVGIITRTDIREEV
gi|170077188|ref|YP_001733826.     RKVITVSPRASLSDVLYLLNRYQISRLPVVDN-DQLQGIITRSDIIRAEA
gi|158334130|ref|YP_001515302.     PQPLTVGPSASLSDVLYILNRSHISRLPVLDG-RKLIGIITRADIIHAEF
gi|119510301|ref|ZP_01629437.1     HSPITVKPKHHLSNVLYLLDRYQISRLPVVEG-RKLVGIITRADIIRAQA
gi|186682049|ref|YP_001865245.     TVPMTVTPTHTLGNVLYLLDRYQISRLPVVNG-RKLIGIITRADIIRAEA
gi|75908381|ref|YP_322677.1|_C     ANPMTVTPIHTLSNVLYLLDRYQISRLPVVDG-QKLIGIITRADIIRVEA
gi|17232383|ref|NP_488931.1|_h     ANPMTVTPIHTLSNVLYLLDRYQISRLPVVEG-QKLIGIITRADIIRVEA
gi|225516217|ref|ZP_03763190.1     PQPVTVTPKQTLSNVLYLLDRYQISRLPVVER-QKLVGIITRADIIPAEA
gi|254413597|ref|ZP_05027367.1     SHPITVKPTASLVDVLYLLNRYQLSRLPVTEG-RKLLGIITRSDIIRAEL
gi|186683293|ref|YP_001866489.     PEPVTVTPTATLAHVLHILNRYHLSCLPVTEN-RKLIGIITRSDIIRVEA
gi|225522175|ref|ZP_03768989.1     PEPVTVTPTATLAHVLHILNRYHLSCLLVTEG-RKLIGIITRSDIIRVEA
gi|186682226|ref|YP_001865422.     PEPVTASPTATLAYVLHILNRYHLSCLPVTEG-RKLIGIITRSDIIRVEA
gi|220909579|ref|YP_002484890.     PWPITIPPQESLANVLYLLNRYNLSRLPVVEG-RKLIGIITRSDIIRAEA
gi|37523751|ref|NP_927128.1|_c     PQPVTVTPRDSLKEVLYLLNRYELSRLPVVEE-AKLVGIITRSDIIRAEA
gi|119486852|ref|ZP_01620827.1     SKPIAVTPDETLTQVLYLLGKYKPSRLPVVEG-RHLVGIITRSDIIKAEL
gi|209525724|ref|ZP_03274261.1     PQPVTIYPDAPLSEVLYLLGRQKLSRLPVVEG-RHLVGIITRSDIIRGEL
gi|220908306|ref|YP_002483617.     QRLISVGPGDRLAHVLYLLNHYQISRLPVTEG-RKLVGIITRADIIRAEC
gi|81300397|ref|YP_400605.1|_C     PHPLTVAPQDTLAHVLYVLNRFQISRLPVVDG-RKLVGIITRADIIRAES
                                    ::  .     * **.:*.:. * **   :      * *****:***  :
```

FIGURE 5 (continued)

```
gi|218440518|ref|YP_002378847.   KQLGGG--TMQGSKPAPSYVTYQTRSPALGNGRILLPLSDGEMAGTLLQI
gi|196258397|ref|ZP_03156931.1   KQLGG---GTQGTKPPPSYVVYQTRSPALGNGRILLPLSDPEMAATLFQI
gi|126659209|ref|ZP_01730347.1   NQLGDDTTINEVVPDPSYIAYQTRAPLAGDGRILLPLVNPDTATSLFKI
gi|172034995|ref|YP_001801496.   NQLQGDDTTINEVVPDPSYIAYQTRAPLAGEGRILLPLVNPDTATSLFKI
gi|67923321|ref|ZP_00516804.1|   NQLQGDDTTINEVVPDPSYIAYQTRAPLVGVGRILLPLTNINTATSLFKI
gi|218248189|ref|YP_002373560.   NQLEGNDSKLNEAIPEPSYIAYQTRAPATGGGRILLPLADPKTATALFQI
gi|159026894|emb|CAO89145.1|_e   DQLGGVCQLPQPT--TPSYVVYQTRSPAVGIGRILLPIANPDTATALFKI
gi|166366612|ref|YP_001658885.   DQLGGVCQLPQPS--TPSYVVYQTRSPAVGIGRILLPIANPDTATALFKI
gi|16331172|ref|NP_441900.1|_c   SQLGG----QIIHPPHPAYSVYQTRSPLVGEGRILLPIRDSDSALVLFQI
gi|170077188|ref|YP_001733826.   QELLG--KSHHAVQRTPSYCVYQTHTSDNYKRKLWVAIANPNTAEALITF
gi|158334130|ref|YP_001515302.   DHISGQ-KQQDNQAFAPSYGVYLTRGPATGEGRILLPLANPDTAEPLLKV
gi|119510301|ref|ZP_01629437.1   EHLNYG-NVTPESQPEPSYVVYQTRSPNIGRGRLLVPVANPETAAILLQM
gi|186682049|ref|YP_001865245.   DHLNCG-NGTPKLQPEPSYIVYQTRSPNIGRGRLLVPVANPDTAGILLQM
gi|75908381|ref|YP_322677.1|_C   DRLNCE-NPNPGPQPEPSYVVYQTRSPSTGRGRILVPVANPETAATLLKM
gi|17232383|ref|NP_488931.1|_h   DRLNCE-NPNPGPQPEPSYVVYQTRSPNTGRGRILVPVANPETAATLLKM
gi|225516217|ref|ZP_03763190.1   DHLNCE-NGVSGPQPEPSYVVYQTRSPNIGRGRLLVTVANPDTAETLLQM
gi|254413597|ref|ZP_05027367.1   DQLDSK-TTQTRSQSEPSYVVYQTRSPETGRGRLLVPIANPQTAPILVKL
gi|186683293|ref|YP_001866489.   ERLSGN-SQQIERKSAPSYVVYQTRAPATGKGRLLVPLSHPQTAETLLEM
gi|225522175|ref|ZP_03768989.1   ERLSGN-SEQMERKLAPSYVVYQSRAPATGKGRLLVPLSHPQTAETLLEM
gi|186682226|ref|YP_001865422.   ERLNGN-TQQIESKSATSYVIYQTRAPATGKGRLLVPLSHPQTAETLLEM
gi|220909579|ref|YP_002484890.   SELSGE-RQQLAPRVQPSYLVYQTRCTASGQGRLLLPLANPATADRLLQM
gi|37523751|ref|NP_927128.1|_c   DLLSGD-TQAVGPRPDPSYVVYQTRAPALGGGRLLLPLANPDTAPALLEF
gi|119486852|ref|ZP_01620827.1   GILSGE-DTQVGLHPEPSYVVYQTRAPQVGQGRMLVSLHNPKTAPSLLEI
gi|209525724|ref|ZP_03274261.1   GYISG--SHQVGHHATPSYVVYQTRGPMVGHGRLLVALNNPTTAPALLHI
gi|220908306|ref|YP_002483617.   DRLSGE-ASPLKVKPAPSYPVYQTQSSTTAQGRLLVPLSNPQTTDALLRL
gi|81300397|ref|YP_400605.1|_C   ELLSGQ--DIAATPIAPSYVAYETRSPATGQGRLLVLLANPRTAQSLLQL
                                        :   .:*  *::.    ::::.  :  *..

gi|218440518|ref|YP_002378847.   AAAIARHRNYEIECLQVIKVPRHQFPSEARIDIHHSRKLMQRMERLARHL
gi|196258397|ref|ZP_03156931.1   AATIARHRHYEIECLQVIKIPRHQFPSEARVEVHHSRKLMQRMERLGRHL
gi|126659209|ref|ZP_01730347.1   SSAIAQQQNQEIECLQVITVPKHSDPAQTPVITQHSRQLLQRTERLGRHY
gi|172034995|ref|YP_001801496.   SAAIAQQQNQEIECLQVITVPKHSDPAQTPVITQHSRQLLQRTERLGRQY
gi|67923321|ref|ZP_00516804.1|   SAAIAEQQNQEIECLQVITIPKHSDPAQTTVITQQSRQLLQRAERLGRQH
gi|218248189|ref|YP_002373560.   GAAAIARQQNDELECLQVIKVPKHKKPAQTPVKSQHSRHLLHRMERLGRRQ
gi|159026894|emb|CAO89145.1|_e   AAAVARERNYEIDCLYVITVPRLSSPAEVKVDTREGRKLLHRLERLARQQ
gi|166366612|ref|YP_001658885.   AAAIASERNYEIDCLYVITVPRLSSPAEVKVDTREGRKLLHRLERLARQQ
gi|16331172|ref|NP_441900.1|_c   AAAIAKQNYEIDCLQVVKVSKAQSPSVQRVQWQRQRQLMQKLERIARHQ
gi|170077188|ref|YP_001733826.   AAAIAKEKNAMVYCLNVVQVAATYPLTDAHMNTYPERHLMEKLERLGETL
gi|158334130|ref|YP_001515302.   AVAMAQALNYELECLHIIRLPRNRLPAETPVQTVKGRRLLQKAIRYGQRH
gi|119510301|ref|ZP_01629437.1   AAAIARDRHYEIECVQIILVSRHNSPSETSVRTAKSRRLLRQAEVLAKKW
gi|186682049|ref|YP_001865245.   AAAIARDRHYEIDCVQVMLIPRHSSPSETQVRTAKSRRLLRQAEVLAKKW
gi|75908381|ref|YP_322677.1|_C   AAAIARDRHYEIECVQVMLVSRHSSPSETTVRTAKSRRLLRQAEVLAKKW
gi|17232383|ref|NP_488931.1|_h   AAAIARDRHYEIDCVQVMLVSRHSSPSETTVRTAKSRRLLRQAEVLAKKW
gi|225516217|ref|ZP_03763190.1   AATIARDRHYELECLQIILISRHSSPSETQVNTTKSRRLLRQAKALAKKW
gi|254413597|ref|ZP_05027367.1   AAAIARDRDYELECLQVILVSRSTSPAETPVTTTKSRRLLRQAEKWGRDW
gi|186683293|ref|YP_001866489.   AVAIAKDRNYEIECLQVIIVPSGRIPSETPVQISKSLQLLQRAILLGENS
gi|225522175|ref|ZP_03768989.1   AVAIAKDRNYEIESLQVIIVPSSRIPSETPVQISKSLQLLQRAILLGENS
gi|186682226|ref|YP_001865422.   AGAIAKANNYEIECLQVIIVPSNRIPSETPVQITKSLELLQKAILLGEKW
gi|220909579|ref|YP_002484890.   GLAIARERQLELECLQVIVVPRHSDPSTTPVRTTLNRRLLQRMERLARPD
gi|37523751|ref|NP_927128.1|_c   ALAIARARNLELECLHVIAVPRTSAPSSTPVAVAPAVNLVRQAVRAGRAV
gi|119486852|ref|ZP_01620827.1   AAAIARERNYEIECLNVITIPRHRSPSETPVRLTKSRRLMRQAEQMGRAW
gi|209525724|ref|ZP_03274261.1   AAAIAAERNYELECLTIITIARNLSPAETPVSITKCRRLLRQAERIAKSW
gi|220908306|ref|YP_002483617.   AAAIAQQHHYDLECLHIIPIPRHSRPSETSVDITASRQMMEHAVAGGQTW
gi|81300397|ref|YP_400605.1|_C   AAGLASLRNYELECLHLIPVSREADPSQTAVSTLGARRMLRQAERLGRRW
                                   .:*   . :.:  :: :.     :    :    ..::.:  ..
```

```
gi|218440518|ref|YP_002378847.    NVPVHTQIRIAQDTAQSIIETIQERHINLMLMSWKGGGDTQGAIFGNVTD
gi|196258397|ref|ZP_03156931.1    NIAVHTQVRVAQDTAESIIETIQQRHISLMLMSWKGISDSQGAIFGSVAD
gi|126659209|ref|ZP_01730347.1    HIPVHTQIRVAHDRAQAILDTIRERHINLMVLEWTDDHHTPGTIFDPVID
gi|172034995|ref|YP_001801496.    HLPVHTQIRIAHDRAQAILDTIRERHIDLMVLQWTDDNHSPGTIFDPVID
gi|67923321|ref|ZP_00516804.1|    QISVHTQIRVAHDRAQAILDTIRERHINLIVLEWNPDKKTPGSVFGPVID
gi|218248189|ref|YP_002373560.    KLPVHTQVRVAHDIAQGILDTIRERHINLMVMEWNGETGTPGFGHVVD
gi|159026894|emb|CAO89145.1|_e    NISVHTQISVAQDIAEGILATIRERHSNLLIMGWTGERSTTGAIFGFLVD
gi|166366612|ref|YP_001658885.    HISVHTQISVAQDIADGILATIRERHSNLLIMGWTGEKSTTGAIFGFSVD
gi|16331172|ref|NP_441900.1|_c    RVLFHTEIKLAYSITDTILDTIQTRHSDLLILEWQGEMPIGGQIFGQITD
gi|170077188|ref|YP_001733826.    GISIHTQVILAYDVAGAILQEISSKDQ-GLILGWQGDRHPGGQLFGSVME
gi|158334130|ref|YP_001515302.    QVSVHTQIIAAQDVAQAILEVEQTEHINLLLMGWQGQFFSGGQIGNPTVR
gi|119510301|ref|ZP_01629437.1    KIPLHTQIRVAHDPAEAILETIHERHINLILMGWKGETSTPGRIFGNVVD
gi|186682049|ref|YP_001865245.    KIPLHTQIRVTHDVAQAILETINEQHIDLILMGWKGNTSTPGRIFGNVVD
gi|75908381|ref|YP_322677.1|_C    RIPLHTQIRVAHDPAHAILETIKDRHIDLILMGWKGSTSTPGRIFGNVVD
gi|17232383|ref|NP_488931.1|_h    RIPLHTQIRVAHDPAHAILETIKDRHIDLILMGWKGSTSTPGRIFGNVVD
gi|225516217|ref|ZP_03763190.1    HIPIHTQIRVAHDIAQAILETINERHIDLIFMGWKGNTSTPGRIFGNVVD
gi|254413597|ref|ZP_05027367.1    NIPVHTQIRVSQDITQGILDTIKERHINLMMMGWKGSTSTPGRIFGGVVD
gi|186683293|ref|YP_001866489.    RIPVHTQIRVAHNVAGAILETVKERHIDLVLMGWKGSTSTPGRVFSRVVD
gi|225522175|ref|ZP_03768989.1    RIPVHTEIRVAHNVAGAILETVKERHIDLVLMGWKGSTSTPGRVFSRVVD
gi|186682226|ref|YP_001865422.    RIPVHTQIRVTHNVAGAILETVKERHIDLVLMGWKGTTSTPGRVFSRVVD
gi|220909579|ref|YP_002484890.    SVPLHTQIRVAQDVAGAILETISDRHIDVVLMGWEGESLTPGSIFGSVVD
gi|37523751|ref|NP_927128.1|_c    GVPVHTQVRVAHDIAQAVLETVKERRIGLVLMGWRGVNTSPERIFSNTVD
gi|119486852|ref|ZP_01620827.1    KIPLHTQVRVTNDVAQAILETTKERHIDLILMGWQGKSSTSDRVFGNVVD
gi|209525724|ref|ZP_03274261.1    RVPIHTQIRVSHDVSGAILETVQERNIDLTLIGWQGERSATNRVFGTVVD
gi|220908306|ref|YP_002483617.    QVPVHTQIRVAQDIAMAILETIRDRHIDLVLMGWEGVTLTPGRIFGTVVD
gi|81300397|ref|YP_400605.1|_C    QIPVHTQVRVCHDLSAAILETISDRHINDLVMGWGGGASLAQRLFREGID
                                  : .**::      . :  ::    .    .: * gi|218440518|ref|YP_002378847.    TLIHKAPCDLMLVKLGASPTAYPHN---------------LEHNATWLVP
gi|196258397|ref|ZP_03156931.1    TLIHKAPCDLMLVKLGASANAYPLN---------------LEHNATWLVP
gi|126659209|ref|ZP_01730347.1    ILIRKATCELILVKLGQEKEAYPQI---------------LDKDTTWLIP
gi|172034995|ref|YP_001801496.    VLIRKATCELVLVKLGQEKEAYPQT---------------LDKDATWLLP
gi|67923321|ref|ZP_00516804.1|    ILIRRATCELVIVKLGKEKEAYPQT---------------LDKDTTWLIP
gi|218248189|ref|YP_002373560.    LLIRKAPCELVLVKLGNREPSYPDS---------------LNRDATWLIP
gi|159026894|emb|CAO89145.1|_e    TLIAQAPCETILVKLG-TKDCFPND---------------PNRERIWLIP
gi|166366612|ref|YP_001658885.    TLIAEAPCETILVKLG-TKDCFPND---------------LNRERIWLIP
gi|16331172|ref|NP_441900.1|_c    RLIDQAPCSLLMVKQGTNDHAYPRY---------------LSPMAHWLMP
gi|170077188|ref|YP_001733826.    YLVKKVPCDVILVKTSHAHPLQFKA---------------QTGKIRALVP
gi|158334130|ref|YP_001515302.    TILQQAKSQVLVIRPATHFNTG-------------------KNQRWLIP
gi|119510301|ref|ZP_01629437.1    TIIRQDCVMLVKLGNTPHSLLP--IPHS-------PFPTPKFNRWLVT
gi|186682049|ref|YP_001865245.    NIIRQATCEVVLVKLGKTQHKPNHSYPQTA-------LQTQHSFNRWLVP
gi|75908381|ref|YP_322677.1|_C    TIIRQATCDVVLVKLGTS------------------PIPNPPFNRWLVP
gi|17232383|ref|NP_488931.1|_h    TIIRQATCDVVLVKLGSSPFPIPN---TQY-------PISNPQFNRWLVP
gi|225516217|ref|ZP_03763190.1    TIIRQAACDVVLVKFGNIS-------------------DSNHFNRWLVP
gi|254413597|ref|ZP_05027367.1    AVIRQAPCDVMVVKLGEMMHPPYIP---------------PFFQRWLIP
gi|186683293|ref|YP_001866489.    TIIRQAGCDVILAKLDDKRS----------------------FDRWLLP
gi|225522175|ref|ZP_03768989.1    TIIRQAGCDVILAKLDDKRS----------------------FDRWLLP
gi|186682226|ref|YP_001865422.    TIIRQAGCDVVLAKLDDKRA----------------------FDRWLLP
gi|220909579|ref|YP_002484890.    TIVHQAECDVVLVKLAQENVR---------------------FDRWLVP
gi|37523751|ref|NP_927128.1|_c    TIIRQAPCEVLLVKLK-GDAI--------------------PRRWLVP
gi|119486852|ref|ZP_01620827.1    MIIRACECEMVLVKWPQMVDPFGSKRK-LR-------LHSLLGWQRWLVP
gi|209525724|ref|ZP_03274261.1    TIIRQVPGEVVLVKWGKNVNPIFSDPSDQR------SLQFPVWRRWLVP
gi|220908306|ref|YP_002483617.    TIVREASCNVVLVRPGKQLILPLAKAADLSGQSALTLLMRLFTLNRWLVP
gi|81300397|ref|YP_400605.1|_C    QILQQAPCRVLLVKPGAAFLAKAPLLQGDR---------PTLPLRHWLIP
                                  ::       ::  :                              *:.
```

FIGURE 5 (continued)

```
gi|218440518|ref|YP_002378847.   MAGGPNAQRAIELLPSLTTLYANPN----APELWLCKVYPP--TELEPNS
gi|196258397|ref|ZP_03156931.1   MAGGPNAQRAIELLPSLTRLYSNPD----APQLWLCKVYPP--SEIEPDS
gi|126659209|ref|ZP_01730347.1   IAGGPNAKRAMELLPGLTKLYTRPR----SPIIWLCQVFPP--HKSTPNY
gi|172034995|ref|YP_001801496.   IAGGPNAKRAMELLPGLIKLYTRPR----SPIIWLCQVFSP--HKATPNY
gi|67923321|ref|ZP_00516804.1|   IAGGPNAKRAMELLPGLTQLYTRPR----SPIIWLCQVFSP--HKPTPDY
gi|218248189|ref|YP_002373560.   IAGGPNAQRALELLPGLTGLYDRPR----SPIIWLCKVFPP--AGALPDY
gi|159026894|emb|CAO89145.1|_e   TAGGPNAQRALALLPSLLSLSESSD----YPKLWLCKIYSP--TDLLPDL
gi|166366612|ref|YP_001658885.   TAGGPNAQRALALLPSLLSLSESSD----HPELWLCKIYSP--TELLPDL
gi|16331172|ref|NP_441900.1|_c   VAGGPNIEKMLNLLPALFSLYPEEN----NPQLLISKVYLPRQSQRYDPF
gi|170077188|ref|YP_001733826.   IAGGPNAERAQEFIPALLHLSPEVVRYSLPSQICLCQVYQP--QQRPQHF
gi|158334130|ref|YP_001515302.   VSGGPNVQQAIQLLPALVPISKSPK-------LKLFQVYPP--SSDLPDQ
gi|119510301|ref|ZP_01629437.1   MAGGPNVRVAIKLLPALATLGDNP-------YIRLTQVFKP-SQLKPDMT
gi|186682049|ref|YP_001865245.   MAGGPNSPLAIKLLPALITLGNDP-------QIRLTQVFNP-SELKPDMS
gi|75908381|ref|YP_322677.1|_C   MAGGPNARIAIKLLPALVTLSDDP-------QIRLTRVFKP-WEFRPDMT
gi|17232383|ref|NP_488931.1|_h   MAGGPNARIAIKLLPALVTLSDDP-------QIRLTRVFKP-WEFRPDMT
gi|225516217|ref|ZP_03763190.1   MAGGPNVTKAVKLLPALVTLGNNT-------QIHLTQVFKP-SELKPDIT
gi|254413597|ref|ZP_05027367.1   IAGGPNSQRALEFLPALIPLSSKPP------DIRLCQVFDP-EDTIMDTT
gi|186683293|ref|YP_001866489.   MAGGPNSSQAIKLLPALSSLSTS-------PQIKLCQVFQP---TNSILD
gi|225522175|ref|ZP_03768989.1   IAGGPNSSQAIKLLPALSSLSRS-------SQINLCQVFQP---NNSIPD
gi|186682226|ref|YP_001865422.   MAGGPNSSQAIRLLPALASLSKS-------PQINLCQIFQP---TKSLPD
gi|220909579|ref|YP_002484890.   IAGGPNVQRAMQLLPGLTRLSPA-------PQVRLCQVFDP---EATLLD
gi|37523751|ref|NP_927128.1|_c   IGGGPNAQEAIKILPALLRRGPGK------SEIAVCQVFAP---DNPAHD
gi|119486852|ref|ZP_01620827.1   IRDDAKKSVAVQLLPALTHLSHQ-------AEIRLLKVMNK---EVSVSE
gi|209525724|ref|ZP_03274261.1   LRTGGPPPAAMGILPGLARLSLR-------PDIRLLTVVKN---ALSEAE
gi|220908306|ref|YP_002483617.   VAGGPNAQYALTLLPALVALSQHP-------QIRLCQVFSP---SEPYHD
gi|81300397|ref|YP_400605.1|_C   LSAQVPQTGLAEPLEQILQLITDPD-------ISLCQIDLP----RQTVS
                                          : :                    : : :

gi|218440518|ref|YP_002378847.   QALEEAAQTLTEKLNKSIIP-ISIRSHSVADALIHLAQAEVCDLIILGAS
gi|196258397|ref|ZP_03156931.1   QGLEEAAQILRDKLNKPIFP-ISIRSNSVSDALIQLARAEECDVIVLGAS
gi|126659209|ref|ZP_01730347.1   QALEIEAKRLKEELERPVIP-LPVRSQSVADAIIHLAEAESCDVVMLGVS
gi|172034995|ref|YP_001801496.   QSLEVAAKRLKEELERPVIP-LPVRSQSVADAIIHLAEAETCDVVMLGVS
gi|67923321|ref|ZP_00516804.1|   QSLEAKAQQLKEQLERPVIP-LPIRSQSVTDAIVHLAESESCDVVMLGVS
gi|218248189|ref|YP_002373560.   QVLEQTAQAVKDAVARPVIP-LPIRSQSVADAVVHLAAAETCDVVMLGVS
gi|159026894|emb|CAO89145.1|_e   SILEVLQASLQKAIAQPIVP-LPIRSASPAEAIINLVESEDCSLVLLGAS
gi|166366612|ref|YP_001658885.   STLEVLQASLQKAIAQPVVP-LPIRSASPAEAVINLVESEDCSLVLLGAS
gi|16331172|ref|NP_441900.1|_c   YDLKNLAERWSEQLQRPIIP-IPVCSTSIADALSDLAEMRECAAIVLGAS
gi|170077188|ref|YP_001733826.   PLLVKAKRGLDPLVEIPIIP-LPIRSSHIADSLIRLIKEETYDLVILGAS
gi|158334130|ref|YP_001515302.   SILEHYSQFLKQACPDSAVKRTQICAQNVADAIVELARLQKTDIIVIGAS
gi|119510301|ref|ZP_01629437.1   VLEQAIRILMRRRKLSSNVVAIPVQADSVAEGVINLVKTEGYDVVVLGAS
gi|186682049|ref|YP_001865245.   ISEQAIRQLMRRRKLSSTVVAIPVQADSVAEGVINLVKTEGYDVVVLGAS
gi|75908381|ref|YP_322677.1|_C   VLEQAIRQLMRRQLSSTVIAAPVQADSVVEGVIKLVKTEGYDVVVLGAS
gi|17232383|ref|NP_488931.1|_h   VLEQAIRQLMRRQLSSTVIAAPVQADSVVEGVIKLVETEGYDVVVLGAS
gi|225516217|ref|ZP_03763190.1   VLEESTHQLMRHRNLQSTVVAAPVQANSVCEGVINLVQTERYDVVVLGAS
gi|254413597|ref|ZP_05027367.1   AIEEASDFLKKQTEG--RIRRIPIRASEVSDAVVYIANNQLCDVVVLGAS
gi|186683293|ref|YP_001866489.   TTLLDKSVHFLQRRVSGKVVATPVRANSVSDAVLKCAELDNSDVIVLGAS
gi|225522175|ref|ZP_03768989.1   TTLLDKSVNFLQCRVSGKVVATPIRANSVSDAVLQCAEQDKSDVIVLGAS
gi|186682226|ref|YP_001865422.   TTLLDKSVHFLQRRVKGKVVATPVQANSVSEAVLECAQQDNSDVIVLGAS
gi|220909579|ref|YP_002484890.   TQALEQGMALLKPHLNGALSSLSLRSKSIAEAIIELAHAEQDDVILVGAS
gi|37523751|ref|NP_927128.1|_c   TGLLDADAESLGRSLGYPVRALPLFSKSVAQAIVQCTSEGHFDGVIIGAS
gi|119486852|ref|ZP_01620827.1   KRAWEHTSQELSSLLNSKVRITAVTSEFVPDAVIDFAYQEHCDVIVLGAS
gi|209525724|ref|ZP_03274261.1   MAKLDHLVEELKSPINGEVVATAVCARSVVDVLLDIANHDYCDVIVLGAS
gi|220908306|ref|YP_002483617.   TTLLEQDADFLNQQLQAPVITLTLCADSVADAIVDLVEKDQCDVIVLGAS
gi|81300397|ref|YP_400605.1|_C   ANRLQQLQRRLENRLRQPIQADLICARSVTAVLLDVMQSRGIEAVMLSMT
                                         .  ::    :                :::. :
```

FIGURE 5 (continued)

```
gi|218440518|ref|YP_002378847.    REGLLQQAIHGNIPDAIASGVDSTVIVVRGAID----------------
gi|196258397|ref|ZP_03156931.1    REGLLQQAIHGNIPDAIARGVDSTVIVVRGAID----------------
gi|126659209|ref|ZP_01730347.1    REGLLVQVMQGNIPKMIAQQVKSTVILVRGKLDN---------------
gi|172034995|ref|YP_001801496.    REGLLVQVMQGNLPKMIAQQVKSTVILVRGKLDN---------------
gi|67923321|ref|ZP_00516804.1|    KEGLLAQVMQGNIPKTIAQQVKSTMILVRGKLDN---------------
gi|218248189|ref|YP_002373560.    REGLLEQVIHGNIPKATAKQVDSTVILVRGAL-----------------
gi|159026894|emb|CAO89145.1|_e    RESLLNQFLNGNIPSTIARAVNCTVILVRGELSD---------------
gi|166366612|ref|YP_001658885.    RESLLNQLLNGNIPSTIARAVNCTVILVRGELSD---------------
gi|16331172|ref|NP_441900.1|_c    REGLLKNVIHGNLPTQIASQTNTTVFIFRGPVDSPNEEAIVPPLAPDFGL
gi|170077188|ref|YP_001733826.    RESLFQKALHGNIPEAIAKGTNRTVVIIRGALDVTDPE-----------
gi|158334130|ref|YP_001515302.    PTGLVHQALKGNIPLAIAQGTEATIILVRGSGTNVVV------------
gi|119510301|ref|ZP_01629437.1    REGLLQQAVQGNIPEAIASGVDCTVILVRGAISS---------------
gi|186682049|ref|YP_001865245.    REGLLQQAIQGNIPEAIASGVESTVILVRGAIHK---------------
gi|75908381|ref|YP_322677.1|_C    REGLLQQAIQGNIPEAIASGVDITVILVRGAIES---------------
gi|17232383|ref|NP_488931.1|_h    REGLLQQAIQGNIPEAIASGVDSTVILVRGAIES---------------
gi|225516217|ref|ZP_03763190.1    REGLLQQTIQGNIPETIASGVESTVILVRGEINS---------------
gi|254413597|ref|ZP_05027367.1    REGLLQLMIQENIPEAIARRVKSTVILVRSAT-----------------
gi|186683293|ref|YP_001866489.    RESLLQQAIAENISRKSNCTVIMVKT-----------------------
gi|225522175|ref|ZP_03768989.1    CESLLQQAIQGNIAENISRKSNCTVIMVKT-------------------
gi|186682226|ref|YP_001865422.    RESLLQQVIQGNIAENISRKSNCTVIMVKT-------------------
gi|220909579|ref|YP_002484890.    REGLLRQAIMGNIPSAITRNSHCSVILVRGALE----------------
gi|37523751|ref|NP_927128.1|_c    RESLLRQAIRGNIPETVAKGSDCTVVVVRT-------------------
gi|119486852|ref|ZP_01620827.1    REGMLKQVIQGNIPEAIARHCDCTVILVRPAIGHAAD------------
gi|209525724|ref|ZP_03274261.1    GESMLQQAIKGNIPEAIARGCPCTVILVRPPIMN---------------
gi|220908306|ref|YP_002483617.    REGLLQQVIQGNIPEQIARHSDCTVILVRKALSAE--------------
gi|81300397|ref|YP_400605.1|_C    ----LEQLPTTTLWKDLLAQAPQTVIIQRR-------------------
                                       .:     :         ::.:  :

gi|218440518|ref|YP_002378847.    --
gi|196258397|ref|ZP_03156931.1    --
gi|126659209|ref|ZP_01730347.1    --
gi|172034995|ref|YP_001801496.    --
gi|67923321|ref|ZP_00516804.1|    --
gi|218248189|ref|YP_002373560.    --
gi|159026894|emb|CAO89145.1|_e    --
gi|166366612|ref|YP_001658885.    --
gi|16331172|ref|NP_441900.1|_c    DE
gi|170077188|ref|YP_001733826.    --
gi|158334130|ref|YP_001515302.    --
gi|119510301|ref|ZP_01629437.1    --
gi|186682049|ref|YP_001865245.    --
gi|75908381|ref|YP_322677.1|_C    --
gi|17232383|ref|NP_488931.1|_h    --
gi|225516217|ref|ZP_03763190.1    --
gi|254413597|ref|ZP_05027367.1    --
gi|186683293|ref|YP_001866489.    --
gi|225522175|ref|ZP_03768989.1    --
gi|186682226|ref|YP_001865422.    --
gi|220909579|ref|YP_002484890.    --
gi|37523751|ref|NP_927128.1|_c    --
gi|119486852|ref|ZP_01620827.1    --
gi|209525724|ref|ZP_03274261.1    --
gi|220908306|ref|YP_002483617.    --
gi|81300397|ref|YP_400605.1|_C    --
```

FIGURE 5 (continued)

```
MSEVYWQAKIWGLLHDPALKALHNNSGRGGEGAWQSLGCMQNWVSPKSSTEKKDGELSN
            ---1---

SWLDHIGLSDLIASASDRGAIHYIGTPIDYDGKGLELSHLLSGAKLPLKLANHSEIIGQ

GNRRTYLEQKELELIQQMPAEFLHGTDKAQECFWWLWRCLPEAVAEQFGPESLLMPAET
                                                       ---2
RLPDASIWSHGSMTAALAGALAGYDTNIEDIAKGARNTPKSQAYLAVFTFSPIQELIKA
2---                                        ----3----
                                                       ---
SRKIKDFWAGSWILHYLSAKVCWELAQQYGPDCFLYPSLYGQPLIDHWLLEKYGEQGFS
     -----4------                  --5--
--11---------------
QWVPQPGDRQLLTAGFPNVIMLVLPKEKVSAAMQSAKNHLLNAWRNIAHLVFAELQQRH
               --6--
        ---12---
WQKQLNPTDPTWKHWLDAQWQTYWSAMAIGAEGKTLKSVGIPTQTPESKAQRDQWVREQ

NEAFSASLFAQEELDFIEKSTDLFIQQRNRNYAGSLNVGSWWADIFGQTRFTLSAVKNA

RNWKIPTAFGPRSTISGLGPVVHPQAPSHQRDWVTEGDTQKYWQRQAGLFDGSEQLNAT
                                                --------13--

ETVKRGLEKVLPALLGRGAKELKTYYPDLTVGIAGYLKTQPDGLPIFEQACSAISQKIL

-----
GDRHKVADSVTQDWGIPWVEENMEKKYHPRLLNSGWLVEELEDLDQTELPSYRQALQTE

IEKFYPQNNPTSWYVLAAGDGDGMSEWLKGTKMRTYGDYFPQVLTVPEDLQPTFQPFSE
                 ---7--

QPKRMGPATHNALSRALLDFSNQLVPYLTEQRYAGRLIYSGGDDVLAYTNLWEWDQWLW
     ----8------                         ------9------
        ---------14---------                   ---15--
DIRQAFRGDRDEHREFDSTGHYWHSKTAHKNLPQRPLFTMGDGATISFGITIAHHSVPL
                                                -----10-----
                                            ---------------16------
AIALEHLWEAEEEAKEHEYGEGEDKKSKDAVQVRVIYGNGNVLTATSKFEVFKTWKDLL

---16------
DIETIDASTYETAATVLEQHPIPVREAIMPWVNVLVERRDALDKDQQSTLRSRLACFLI

QLWQTTSQKNWEKEAKNWLKVAAFMKRNRYIKFPN
```

FIGURE 8

```
CLUSTAL W (1.81) multiple sequence alignment gi|121997427|ref|YP_001002214.      --------------------------MTEATLMDIDLARNKLLARLHD
gi|88810314|ref|ZP_01125571.1|      --------------------------------MTDRLWQAKLHARLHD
gi|255254649|ref|ZP_05334193.1      --------------------------------MSKKEELFENKLKAYFHD
gi|255338062|ref|ZP_05378933.1      --------------------------------MSKKEELFENKLKAYFHD
gi|20808984|ref|NP_624155.1|_h      --------------------------------MEKVWLLKLKAFLHD
gi|254478158|ref|ZP_05091540.1      --------------------------------MEKVWLLKLKAFLHD
gi|38505758|ref|NP_942378.1|_h      --------------------------------MSEVYWQAKIWGLLHD
gi|170079601|ref|YP_001736234.      --------------------------------MAGKAYWQAKIWGLLHD
gi|126661502|ref|ZP_01732553.1      ------------------------------------------------
gi|172035267|ref|YP_001801768.      -----------------------------MSHLYHPYWQAKIWALLHD
gi|86608324|ref|YP_477086.1|_C      --------------------------------MSYYWQAKLWGLLHD
gi|86607166|ref|YP_475929.1|_C      ------------------------------------------------
gi|255256456|ref|ZP_05335917.1      ------------------------------------------------
gi|209526382|ref|ZP_03274910.1      ----------------------------------MDNFLGSLNHS
gi|162453956|ref|YP_001616323.      MSERDRDRDRNLAVAHPVHGRTGDDEIEHHGTEADRTRFWQQKLLQLLHD gi|121997427|ref|YP_001002214.      PAEKALVLLRDPAGHEGGTVRTLIEEILG-------------------
gi|88810314|ref|ZP_01125571.1|      PAEKALVLLRDPAGPEGGTSRVLHERLFP-------------------
gi|255254649|ref|ZP_05334193.1      SPDKPFILLTGENHEKRAKEISKK------------------------
gi|255338062|ref|ZP_05378933.1      SPDKPFILLTGENHEKRAKEISKK------------------------
gi|20808984|ref|NP_624155.1|_h      PPHKHWIISMDNEECIKKFQLQEKGRCHEILIKSKVI------------
gi|254478158|ref|ZP_05091540.1      PPHKHWIISMDNEECIKKFQLHEKGRCHEILIKSKVI------------
gi|38505758|ref|NP_942378.1|_h      PALKALHNNSGRGGEGAWQSLGCMQNWVSPKSSTEKK------------
gi|170079601|ref|YP_001736234.      PALKALYGNPGRGEEGLWKKLACMEGWASPKSSEEKQ------------
gi|126661502|ref|ZP_01732553.1      -------------------------------------------------
gi|172035267|ref|YP_001801768.      PALKPLSDRYGFAREGQWQLLRCMQGCKSPKDNKKVLG-----------
gi|86608324|ref|YP_477086.1|_C      PALKALHDRTGRSKEGLWTRLAAMQGWSSPKA-----------------
gi|86607166|ref|YP_475929.1|_C      -------------------------------------------------
gi|255256456|ref|ZP_05335917.1      -------------------------------------------------
gi|209526382|ref|ZP_03274910.1      SLCNIVFLRKLCALVG---------------------------------
gi|162453956|ref|YP_001616323.      PPGKAFFLRQGAGGHKAVAADLFQATAGVPLKYVRPGPDWAASGADRPVS gi|121997427|ref|YP_001002214.      ---EVPQ-AAWAPVRKADRWASAADRPQFPRERDGDRFARWSQVRFAEQP
gi|88810314|ref|ZP_01125571.1|      ---QGMAGDLRATVRKADWWASAADRPQFPRDGKEGPYARWSQVNFAEQP
gi|255254649|ref|ZP_05334193.1      ---------IDIPYHKTIASDVLASFMERYYIPKDASKNKNLQVVFEEQP
gi|255338062|ref|ZP_05378933.1      ---------IDIPYHKTIASDVLASSMERYYIPKDASKNKNLQVVFEEQP
gi|20808984|ref|NP_624155.1|_h      --EPLLGEDLTEEEEKLIEKADTQAYPVNRILPPVAVKIRGEDVIFFDMF
gi|254478158|ref|ZP_05091540.1      --EPLFGEDLTEEEEKLIKKADTQAYPVNRILPPVAVKIRGEDVIFFDMF
gi|38505758|ref|NP_942378.1|_h      --DGELSNSWLDHIGLSDLIASASDRGAIHYIG----TPIDYDGK----G
gi|170079601|ref|YP_001736234.      --ASELSGTWLDHVGLCDLISSASDRGIIHYIG----TAVDYGAE----G
gi|126661502|ref|ZP_01732553.1      -------------------------------------------------
gi|172035267|ref|YP_001801768.      --DCVLQGNWLNHVGLCDLVASASDRSTIGRLDPQYSAVTYQQQT----G
gi|86608324|ref|YP_477086.1|_C      --------EGSSPIGDADLIASASDRAAIGHLPVAIDYQVEDRGQGLGSG
gi|86607166|ref|YP_475929.1|_C      -------------MGDADLVASASDRAAIGHLPVAIDYQVADCSQSLGPG
gi|255256456|ref|ZP_05335917.1      -------------------------------------------------
gi|209526382|ref|ZP_03274910.1      ----------DRHLCNSLDCLKTSEGQAALFWWEQNQHQLEAIASSSDRV
gi|162453956|ref|YP_001616323.      SPPRPAHVSVDWVKNPILTHPLASGTAAIDLGRRDLPASREQVRALAGDV
```

FIGURE 9

```
gi|121997427|ref|YP_001002214.  VLRHPLTGEKIDLGEHGKL--REIELDTLKAGSLEHFRHLIHRDEAGSVD
gi|88810314|ref|ZP_01125571.1|  VPIHPLTGKAFDLRQQGGL--RETRIEAVKDQSQAHFKRLLK--AAGGDD
gi|255254649|ref|ZP_05334193.1  EFVHPLAANRYNNFVIEKE--VFKKAVDEAVDELSKLD---------FKD
gi|255338062|ref|ZP_05378933.1  EFVHPLAANRYNNFVIEKE--VFKKAVDEAVDELSKLD---------FKD
gi|20808984|ref|NP_624155.1|_h  NKKIYYDILAETDYETENK--RFLELVEKLAKNYNLSR---------IKE
gi|254478158|ref|ZP_05091540.1  NKKIYYDILAATDYETENK--RFLELVEKLAKNYNLSR---------IKE
gi|38505758|ref|NP_942378.1|_h  LELSHLLSGAKLPLKLANHSEIIGQGNRRTYLEQKELELIQQMPAEFLHG
gi|170079601|ref|YP_001736234.  LELSHLLSGEKLPLRLQNHAEILGQSSRKTYLEQTEADLIDQMPAEIRDD
gi|126661502|ref|ZP_01732553.1  --------------------------------------------------
gi|172035267|ref|YP_001801768.  LQIRHLLSGEPQNLKVN------NNWQENLITKRKKLEAKEAEFLDKISQ
gi|86608324|ref|YP_477086.1|_C  LEMSHLLSGRKHFWQLANE-QHQALKNAHSRADYLMEREENAIPDWVRQE
gi|86607166|ref|YP_475929.1|_C  LEMSHLLSGRKRFWQLPEE-EHRALRQASSRAEYLLAQEARVVPDWIWQE
gi|255256456|ref|ZP_05335917.1  --------------------------------------------------
gi|209526382|ref|ZP_03274910.1  NLEPGSSTERQTKERIIKHPISAQQQTIQTPDNREIAFP------QWVQQ
gi|162453956|ref|YP_001616323.  GRTLRELLERRVSQEDELDDLPEEEERERFLSERAEQVESELAALPRWHD gi|121997427|ref|YP_001002214.  SWRTLLALWRFGPEPATSGDATGLGELWRYLPADTRIPDHTIWQHLDLSS
gi|88810314|ref|ZP_01125571.1|  PRRMALTLWRFGPELDTADDTARLGELWRFLPADTRIPDHSIWDHLDLVS
gi|255254649|ref|ZP_05334193.1  SYKKFVYLWRYLKELLKKHTPSEYRKYWDLAPADTRFPNHTIFEHLKLAS
gi|255338062|ref|ZP_05378933.1  SYKKFVYLWRYLKELLKKHTPSEYRKYWDLAPADTRFPNHTIFQHLKLAS
gi|20808984|ref|NP_624155.1|_h  EEKKEK---AKILLLFLWRFYQEIFHWMRIHPADTRAPNHSIYDHLVQTS
gi|254478158|ref|ZP_05091540.1  EEKKEK---AKILLLFLWRFYQEIFHWMRIHPADTRAPNHSIYDHLVQTS
gi|38505758|ref|NP_942378.1|_h  TDKAQECFWWLWRCLPEAVAEQFGPE-SLLMPAETRLPDASIWSHGSMTA
gi|170079601|ref|YP_001736234.  PEAAQACFWWLWRCLPQAVADEFGAA-SFLMPAETRLPDGSIWSHASMTA
gi|126661502|ref|ZP_01732553.1  ------------CLPEATCQLFDDASLLLMPAETRLPDSSHWSHASLTA
gi|172035267|ref|YP_001801768.  WEDPKKVFWALWRCYAEVLEKE--EALIHLLPAETRLPDGSLWSHVSMTS
gi|86608324|ref|YP_477086.1|_C  TD-PQKVFWWFWRCFPQAICQEFGDESLLLLPAETRLPDGSLWSHASVTA
gi|86607166|ref|YP_475929.1|_C  QEDIQKVFWWFWRCFPQALAREFGDESLLLLPAETRLPDGSLWSHTSVVA
gi|255256456|ref|ZP_05335917.1  ----------------------------------MMEEKIYESFAENSS
gi|209526382|ref|ZP_03274910.1  EQNPQNVFNWLWRMMPELRRQQ--DSDALLDPQHYILPDCPIHSYRATVS
gi|162453956|ref|YP_001616323.  DARLQQACLQLWRRLPEEPPPGVAEVVWRHQPADSRAPDHSLWDHLRVTS
                                                                   :  ..    :

gi|121997427|ref|YP_001002214.  ALTGAFAGDGQ---------------GRCALLNVTLGPVQELIAAARTTS
gi|88810314|ref|ZP_01125571.1|  AFAGAFVADAN---------------GECALLNISIGPVQEFIAAARTTS
gi|255254649|ref|ZP_05334193.1  AVNAYFYNELNL--------------NNMTLFIFTIGPVQEYIVQARKTQ
gi|255338062|ref|ZP_05378933.1  AVNAYFYNELNL--------------NNMTLFIFTIGPVQEYIVQARKTQ
gi|20808984|ref|NP_624155.1|_h  TLVSALP-------------------KPAFLLFTIGPVQSFIATARKTS
gi|254478158|ref|ZP_05091540.1  TLVSALP-------------------KPAFLLFTIGPVQSFIATARKTS
gi|38505758|ref|NP_942378.1|_h  ALAGALAGYDTNIEDIAK-GARNTPKSQAYLAVFTFSPIQELIKASRKIK
gi|170079601|ref|YP_001736234.  ALAGALAGYDTELDDIPK-GGQNTPKSHPYLAVFTFSPVQELIKASRKMK
gi|126661502|ref|ZP_01732553.1  AMAGALSGYDLTTEDLTQNGEANKPLSHPYLASFTFSPIQELIKASRKMR
gi|172035267|ref|YP_001801768.  ALAGGLAGYYKQAENYPIKNQKFNDYSRPYLVNFTFSPVQELIKASRKMR
gi|86608324|ref|YP_477086.1|_C  ALAGCLAGYDE-----------PKFARPFLVSFTFNPIQELIKASRKMR
gi|86607166|ref|YP_475929.1|_C  ALAGCLAGYDE-----------PKFTRPFLASLTFNPIQELIKASRKMR
gi|255256456|ref|ZP_05335917.1  NVS-----------------------LFLFTIGPVQQFISQARKTQ
gi|209526382|ref|ZP_03274910.1  AIAGAVDFDERG-----------IVTQYPYLLLFTFSPIQDFIKASRKFL
gi|162453956|ref|YP_001616323.  SLSFLSGRRREG------------PVMPWLLAFSLGPVQRFIAQSRTST
                                .                  :  .::.*:*    *   :*.
```

FIGURE 9 (continued)

```
gi|121997427|ref|YP_001002214.   DLWAGSHLLARLAWEAMRVVCERLGPDAVLFPQLRGVPQVDLWLLEQGL-
gi|88810314|ref|ZP_01125571.1|   DLWAGSHLLARLSWEAMRVVCERLGPEAILFPRLRGIPQVDLWLLRDCG-
gi|255254649|ref|ZP_05334193.1   DLYWGSYILSYLTWVAIEKVIEAYGPDSIIFPELKEQPLCDFWIAKLFN-
gi|255338062|ref|ZP_05378933.1   DLYWGSYILSYLTWVAIEKVIEAYGPDSIIFPELKEQPLCDFWIAKLFN-
gi|20808984|ref|NP_624155.1|_h   DLWAGSYMLSYFIWKIMKFVVERYGADVIVYPNLLGQPLVDLWLSSEVFG
gi|254478158|ref|ZP_05091540.1   DLWAGSYMLSYFIWKIMKFVVERYGADVIVYPNLLGQPLVDLWLSSEVFG
gi|38505758|ref|NP_942378.1|_h   DFWAGSWILHYLSAKVCWELAQQYGPDCFLYPSLYGQPLIDHWLLEKYGE
gi|170079601|ref|YP_001736234.   DFWAGSWILHYLSAKVCWRLAHKYGADCFLYPSLYGQPLIDHWLLQKHS-
gi|126661502|ref|ZP_01732553.1   DFWAGSWILHYLSAKVSWTLANIYGPDCFIYPNLYQQPLIDHWLLQKYSK
gi|172035267|ref|YP_001801768.   DFWAGSWILHYLSAKVSYAIANEYGPDTLLYPCLYQQPLIDNWLLEEYS-
gi|86608324|ref|YP_477086.1|_C   DFWAGSWLLHYLSARISWRLAEKYGPDCLLYPSLYGQPLIDYWLREKYP-
gi|86607166|ref|YP_475929.1|_C   DFWAGSWLLHYLSARLCWRLAEKYGPDCLLYPSLYGQPLIDAWLLEKYP-
gi|255256456|ref|ZP_05335917.1   DLFMGSFLLSYLTFIGMEEVIDRYGPKSIIYPNLSAQPLMEWHLKRCNIN
gi|209526382|ref|ZP_03274910.1   DFWAGSYLLHYLSAQLCWFVAETYGVDAVITPSLWGQEIIDALLLKTYPI
gi|162453956|ref|YP_001616323.   DLWTSSMLLSDLVWHAMVPFVERYGPEAIVYPDLRANPRADVWLWEQANG
                                 *::  .*  :*   :            . . *..:  * *      :  :

gi|121997427|ref|YP_001002214.   ----------APELFAKEPWNERTVTDANPLFSAALPNRFLAVVPAD---
gi|88810314|ref|ZP_01125571.1|   ----------LDRNLFGAQNWMRDPTDGNPLFSAALPNRFLALVPAS---
gi|255254649|ref|ZP_05334193.1   ----------------------NSATTTKDLKTPTLPNRFFAILPTK---
gi|255338062|ref|ZP_05378933.1   ----------------------NSATTTKDLKTPTLPNRFFAILPTK---
gi|20808984|ref|NP_624155.1|_h   NSLTHLSQKEFDEWFKEWNNIPRSKGLEEKLTIANMPNRFLAIAPIN---
gi|254478158|ref|ZP_05091540.1   NLLTHLSQKEFDEWFKEWNNIPRSKGLEEKLSIANMPNRFLAIVPIN---
gi|38505758|ref|NP_942378.1|_h   -----------------QGFSQWVPQPGDRQLLTAGFPNVIMLVLP-----
gi|170079601|ref|YP_001736234.   -----------------EFEDWIQPPDDRQLLTAGFPNVIMLVLP-----
gi|126661502|ref|ZP_01732553.1   -----------------FGFNQWIKQPSQRSLLTAGFPNVLVLVLP-----
gi|172035267|ref|YP_001801768.   -----------------DFKEWIEPHKPDQLLTAGFPNVIIMILPNNHKS
gi|86608324|ref|YP_477086.1|_C   -----------------EFEEWIPQPSPNALLTAGFPNVLLLLLP-----
gi|86607166|ref|YP_475929.1|_C   -----------------PFAEWIPQPSANTLLTAGFPNVILLLLP-----
gi|255256456|ref|ZP_05335917.1   --------------------RKSSISSFIDQPTIPNRFVALIPES---
gi|209526382|ref|ZP_03274910.1   FR----ESFQELSPDGTDPLTRFNERLSTTLATAGFPNTITILVGSS---
gi|162453956|ref|YP_001616323.   ADG------AAPPAHAARYQDVLPEQLNPCSYAGIFPNTFIALVPLGGER
                                                  :**   :       :

gi|121997427|ref|YP_001002214.   -----QAEAIGR-AIEAHLHEWVAETAEGVVSDLLRAVNLHTDP------
gi|88810314|ref|ZP_01125571.1|   -----AAEAIAQ-DITEQLRQWTVGRTEAALQRVLQEAGVEDRR------
gi|255254649|ref|ZP_05334193.1   -----NVEEIRLLNLKKTVKDEYIKIGEYVFSHLVKSND-----------
gi|255338062|ref|ZP_05378933.1   -----NVEEIRLLNLKKTVKDEYIKIGEYVFSHLVKSND-----------
gi|20808984|ref|NP_624155.1|_h   -----EGEALKLGEECEKNFKEQLKSLAKKTVKRLESILNLEGD------
gi|254478158|ref|ZP_05091540.1   -----EGEALKLGEKCEKNFKEQLKSLAKKTVKRLESILNLEGD------
gi|38505758|ref|NP_942378.1|_h   -----KEKVSAAMQSAKNHLLNAWRNIAHLVFAELQQR-HWQKQ------
gi|170079601|ref|YP_001736234.   -----EAQVAAAMQSAKNFLLDAWREIAKEVLAELQGDRHWQTN------
gi|126661502|ref|ZP_01732553.1   -----KDKVETAMQTAKSTLISEWLNISKLVFSELEER-YWMKS------
gi|172035267|ref|YP_001801768.   QQDLKDNPIYAATQLAKRTLKEEWKKLGDQSLEFLQDSKQWQN-------
gi|86608324|ref|YP_477086.1|_C   -----EERVEAAMQFAQQTLKEEWQLAQRVLDHLQADRRWLRQ-------
gi|86607166|ref|YP_475929.1|_C   -----EERLQAAMQFAQQTLKEEWRHLAERALEHLQLERRWLVQ------
gi|255256456|ref|ZP_05335917.1   ----EESKIIKLAHKMEDIVRKKWKEMVDIVLNKFKLIDKIRLDK-----
gi|209526382|ref|ZP_03274910.1   ------ETAQQLGETLCEKLRSEWSAIAQNIREGIPDHPIPELRQGIRDR
gi|162453956|ref|YP_001616323.   ----YLTLLKDLAGEARRAVLGRWRQLADLARRYFLEQAAKRPEAMSDS-
                                                        .
```

FIGURE 9 (continued)

```
gi|121997427|ref|YP_001002214.    ------TTPAYQQAREQLAGFPEVYWSAVGWDEIATDANGEPEAD-----
gi|88810314|ref|ZP_01125571.1|    ------DLHAHRQLREQLQGFPEVHWAAVPYSALTADGERKVRTG-----
gi|255254649|ref|ZP_05334193.1    ---------EQKKLLLRQLSNFPDVYWVALPLEN----------------
gi|255338062|ref|ZP_05378933.1    ---------EQKKLLLRQLSNFPDVYWVALPLEN----------------
gi|20808984|ref|NP_624155.1|_h    ------LEKIQLQIENQLLNYFQVYWAVMPWFEEKESP------------
gi|254478158|ref|ZP_05091540.1    ------LEKIQLQIENQLLNYFQVYWVVMPWFEKKESP------------
gi|38505758|ref|NP_942378.1|_h    ------LNPTDPTWKHWLDAQWQTYWSAMAIGAEGKTLKSVG--------
gi|170079601|ref|YP_001736234.    ------LSDTDPSWKGWLDAQWQTYWSAVAIGDKNSSFKSVG--------
gi|126661502|ref|ZP_01732553.1    ------LSFDHKTWKGWLKSQWQTYWTAVPIGVDKKQEDQEGQLEKIALT
gi|172035267|ref|YP_001801768.    ---------INPNTWDKWLKCQWQTYYTAFPIGDPESDLTCSLRVG-----
gi|86608324|ref|YP_477086.1|_C    ------LHPEDPTWQGWLEHQWQHYWAAVPLGSPAHALKDTG--------
gi|86607166|ref|YP_475929.1|_C    ------LRPEDPTWGGWLEHQWQFYWAAAPLGSPQQRLKDTA--------
gi|255256456|ref|ZP_05335917.1    -----KDEDCNAVIKKQTLDFPEIYWVAMPFKKDG---------------
gi|209526382|ref|ZP_03274910.1    TIAFLQNPQNHKRIEKILEEFSQSGGHDEQNRHDLENWKRKSCWEWRG--
gi|162453956|ref|YP_001616323.    ------ERKAFEATWARQHEDVLFTSWSAAAWPSIERVNDPESLAIR---- gi|121997427|ref|YP_001002214.    --------------RLAEALRPFYEPQAEAPGFLSS---------------
gi|88810314|ref|ZP_01125571.1|    --------------ALAEALRPFYPGDPIEPGFLGS---------------
gi|255254649|ref|ZP_05334193.1    ---------------GDVNRPDWEIQLDKIKDYFN---------------
gi|255338062|ref|ZP_05378933.1    ---------------GDVNRPDWEIQLDKIKDYFN---------------
gi|20808984|ref|NP_624155.1|_h    ---------------KEVLDDYKEIIGETELYKTI---------------
gi|254478158|ref|ZP_05091540.1    ---------------KEVLDDYKEIIGETELYKTI---------------
gi|38505758|ref|NP_942378.1|_h    --------IPTQTPESKAQRDQWVREQNEAFSA--------------SLF
gi|170079601|ref|YP_001736234.    --------IPTQTSDKKADLEKWIEQQNKAFNG--------------KLF
gi|126661502|ref|ZP_01732553.1    SSEIYRENEEIKDSEIIEKDRSWVAIQNQAYGLNE----------NTALF
gi|172035267|ref|YP_001801768.    --------KNETEEQKKDAFEAWCHQQNQLTNPKESLFET-----NEEKF
gi|86608324|ref|YP_477086.1|_C    ---------ILRPPQVSIDADPWVSAQNRTHHLEA----------KQKLF
gi|86607166|ref|YP_475929.1|_C    ---------ILRS-QESIERDPWVSAQNRTYHLKG----------KRQLF
gi|255256456|ref|ZP_05335917.1    ---------------RYITEEDFKDFFEEVQ-------------------
gi|209526382|ref|ZP_03274910.1    ---------LWNAQIDQTWQPYWTAVPLGDPNTSLMIEKNDDDQLSEDWI
gi|162453956|ref|YP_001616323.    --------------EALVAQRPAQALPREDAEALAAWR--------ERHTT gi|121997427|ref|YP_001002214.    -EAWRVLQRPIEVIDPEAGTPATFYRPNPGVLYPALYELSERVMGGVKAT
gi|88810314|ref|ZP_01125571.1|    -RAWRVLSRPLELDG-----AATFYQPNPGVLYPAVYDLVDRVLVAAKSV
gi|255254649|ref|ZP_05334193.1    -SDEVEEIKDLLRYIK----DKGEYGPNIGNIYGLLYSFMEKMMGTRKGI
gi|255338062|ref|ZP_05378933.1    -SDEVEEIKDLLRYIK----DKGEYGPNIGNIYGLLYSFMEKMMGTRKGI
gi|20808984|ref|NP_624155.1|_h    -SEFIESVPKIWSKNK----EKDEEYRDFSIAYSLLLELTEKLLGARKSI
gi|254478158|ref|ZP_05091540.1    -SEFIESVPKIWSKNK----EKDEEYRDFSIAYSLLLELTEKLLGARKSM
gi|38505758|ref|NP_942378.1|_h    AQEELDFIEKSTDLFIQQRNRNYAGSLNVGSWWADIFGQTRFTLSAVKNA
gi|170079601|ref|YP_001736234.    TDTERDFFEKATAKFTEQRNRNYAGSLNAGSWWADICGQTRLALNTVKNA
gi|126661502|ref|ZP_01732553.1    LEKELTFLQKAAKLRQDQQNK-YPFNTNIGSWWAAIFDQTRLALTAVKNG
gi|172035267|ref|YP_001801768.    LKAIFKLTDIETEKEPPKTKYSKQPNLNVGSWWAYVFDQLRTSLNAVKNA
gi|86608324|ref|YP_477086.1|_C    GDEELEFLRVSFWDPQRQQRQYKAGLNVGSWWAAAVEQSRRLQAACKQA
gi|86607166|ref|YP_475929.1|_C    ADPELKFLRISFWDPERQQCRQHKPGLNVGSWWAAAVEATRRLQAACKQA
gi|255256456|ref|ZP_05335917.1    -------------------------KENVGLIYHLGYSALEKSMGIRKNL
gi|209526382|ref|ZP_03274910.1    KKQEKVAQTRVINPPPTTAEKMLYTTLNNGTWWGSIQSRCGQAIQAIKNT
gi|162453956|ref|YP_001616323.    WIPGETFARYAEARYVYARTNRTVHQCERGFDYPLLHHALVSRHGLRKAE
                                                    :   .   :                 *
```

FIGURE 9 (continued)

```
gi|121997427|ref|YP_001002214.    RP-FAAQHEGGYRCSLTGEVEWLTHDRSHLDLPPGQREGHDT--------
gi|88810314|ref|ZP_01125571.1|    RA-FDALEQHGYRCSLTAEAEWLTDNPAHLSLPPGQRDQADT--------
gi|255254649|ref|ZP_05334193.1    RN-FNQYEEIGRKCSICGEHNVIIYRCTREEDEKIEKGKESY--------
gi|255338062|ref|ZP_05378933.1    RN-FNQYEEIGRKCSICGEHNVIIYRCTREEDEKIEKGKESY--------
gi|20808984|ref|NP_624155.1|_h    RE-FEQLEQKGRKCSLCGEFEVLPLDWEKLRSKEKGLVKEKE--------
gi|254478158|ref|ZP_05091540.1    RE-FEHLEQKGRKCSLCGEFEVLPLDWEKLRSKEKGLVKEKE--------
gi|38505758|ref|NP_942378.1|_h    RN-WKIPTAFGPRSTISGLGPVVHPQAPSHQRDWVTEGDTQK--------
gi|170079601|ref|YP_001736234.    RN-WKLPTAFGTRSTISGLGPVVHPQGNGQHRDWLTEGEAQH--------
gi|126661502|ref|ZP_01732553.1    RD-WQIPTAFSTRSTISGLGSVVHPS-----DDWIEEGKTKA--------
gi|172035267|ref|YP_001801768.    RT-WELPTAFTVRSSLSGIGSAVHPIVNEEKPDRISEKEINE--------
gi|86608324|ref|YP_477086.1|_C    RD-WQLPVAFGPRSTVSGLGPVVHPS---PRQGWITEGESRR--------
gi|86607166|ref|YP_475929.1|_C    RD-WQLPVTFGPRSTVSGLGPVVHPS---PRNRWISEGESRR--------
gi|255256456|ref|ZP_05335917.1    RN-FSQINEYGKKCNICGTKEGVIKAG-MGSLQVGKYISEKE--------
gi|209526382|ref|ZP_03274910.1    RT-WAIPISPGVRSTLSGQLSALHPQFRYSGNFREGYGLPIESMRLF---
gi|162453956|ref|YP_001616323.    AQGAAIAEESGEKCTLCGLRQALGAGDAGASVDAQRETARAFWRRFDRNS
                                   :..:  .       :

gi|121997427|ref|YP_001002214.    -----LWSLVAKRHPSWARKGEHLGALAALKRL----------WPQRFCR
gi|88810314|ref|ZP_01125571.1|    -----LWSRLGRKRPTWVRKGEHLGALATLKRL----------WPTLFCE
gi|255254649|ref|ZP_05334193.1    -----KIKLLREQNAIIKKSDDKSITYKYLAQG----------EGLCSRC
gi|255338062|ref|ZP_05378933.1    -----KIKLLREQNAIIKKSDDKSITYKYLAQG----------EGLCSRC
gi|20808984|ref|NP_624155.1|_h    -----QLCGVCLAKRLFPKVMKEELNLSEEMKF----------PSTSEMA
gi|254478158|ref|ZP_05091540.1    -----QLCGVCLAKRLFPKVMKEELSLSEEMKF----------PSTSEMA
gi|38505758|ref|NP_942378.1|_h    -----YWQRQAGLFDGSEQLNATETVKRGLEKV----------LPALLGR
gi|170079601|ref|YP_001736234.    -----YWQRDAGLFDGIEQLNATETVKRGLEKV----------LPKLLDR
gi|126661502|ref|ZP_01732553.1    -----LWKRQAGLFDGIEQLNATETVKRGLHLV----------LPKLLEL
gi|172035267|ref|YP_001801768.    -----FWSEKFGLFDGTEKLNATEIVKRVLHKL----------LPEILNY
gi|86608324|ref|YP_477086.1|_C    -----LWQRQAGLFDGREQLNATETLKRGLYKV----------LPELFRE
gi|86607166|ref|YP_475929.1|_C    -----LWQRQAGLFDGREQLNATETVKRALDKV----------LPELFPT
gi|255256456|ref|ZP_05335917.1    -----ALCIPCFVKRALDKYLGDKVDGKFIDYT----------FPSTAEM
gi|209526382|ref|ZP_03274910.1    --WRLIAEVYPGLFDGSEMLNALELTKRMAWVYGGVGESLGIDFSNLENE
gi|162453956|ref|YP_001616323.    DDGAERLCAVCTMKRVLVRAGVATDERGARRRVGLTAAWAGPATPLDDVC gi|121997427|ref|YP_001002214.    ELAGTLGQEQTPRFVVSTHTMALATS-----------LARAAEEPNPAGG
gi|88810314|ref|ZP_01125571.1|    ELKDTLN-MSFSRFVVSTHTMALATT-----------LDKLG--DAPLAI
gi|255254649|ref|ZP_05334193.1    LTKRAAEIYFKDMFGKNNIEESFPST-----------AEIALLDIINNSD
gi|255338062|ref|ZP_05378933.1    LTKRAAEIYFKDMFGKNNIEESFPST-----------AEIALLDIINNSD
gi|20808984|ref|NP_624155.1|_h    TIGEKRRIADNKEFIAEFKELFGEFK-----------QKLLLPNTVS---
gi|254478158|ref|ZP_05091540.1    TIGEKRRIADNKEFIAEFKKLFGEFK-----------QKLLLPNTVS---
gi|38505758|ref|NP_942378.1|_h    G-AKELKTYYPDLTVGIAGYLKTQPD--------GLPIFEQACSAISQKI
gi|170079601|ref|YP_001736234.    D-PTELKAYYPDLTVGVAGYLKTQSEKNG----EALNQYQDACRAIRTKI
gi|126661502|ref|ZP_01732553.1    E-ADKIQMSYPDLTAGMAGYLKNGTS-------EDLEHFEKTSKAVINEY
gi|172035267|ref|YP_001801768.    E-EQEISLYYPDLTAGVAGYLKNALLNNQQ---SEIDYYKRSCHKIYKEI
gi|86608324|ref|YP_477086.1|_C    LDEDQIAASYPDLTAGVAGYLKTQGR-------REREHFEQACQAVEARY
gi|86607166|ref|YP_475929.1|_C    LDEDEVAASYPDLTAGVAGYLKTHGR-------RELEHFEQACRAVEAIH
gi|255256456|ref|ZP_05335917.1    ASSNFKKRALKDAEVQFNAYIDDIKK---------------IVGENV
gi|209526382|ref|ZP_03274910.1    KIDYSQLIRFPNLSSIASARFAYQDLQQDQNHGKLSQYWQKLQINIKQQF
gi|162453956|ref|YP_001616323.    DRDELRVPFPSTATIAAQGYLCAVATRR--ELQAQVAEVVRCCEDARLPR
```

FIGURE 9 (continued)

```
gi|121997427|ref|YP_001002214.    LSAEQAEAIRNADRVALPRRLAQR------LHHLEHGEL-----LARLPG
gi|88810314|ref|ZP_01125571.1|    DTELRNEIEQRGERVALPRRLADK------LREHPNREL-----IERIPA
gi|255254649|ref|ZP_05334193.1    NDLKTNIKRYKEVFKKWCGDNFDY------ELLYEENLN-----ENYFKT
gi|255338062|ref|ZP_05378933.1    NDLKTNIKRYKEVFKKWCGDNFDY------ELLYEENLN-----ENYFKT
gi|20808984|ref|NP_624155.1|_h    ----------VPKLKDNQLFEIDG------QWLMRESYR-----EEYIKS
gi|254478158|ref|ZP_05091540.1    ----------VPKLKDNQLFEIDG------QWLMRESYR-----EEYIKS
gi|38505758|ref|NP_942378.1|_h    LGDRHKVADSVTQDWGIPWVEEN-----MEKKYHPRLLN-----SGWLVE
gi|170079601|ref|YP_001736234.    TADHHEIANFVRQEWGIPWIDETH-DPLFENLPHPRLLN-----AGWLVE
gi|126661502|ref|ZP_01732553.1    LAEHNKIPDEITDKWGIPWADTN-----PTIKYHPRLLN-----AGWLVE
gi|172035267|ref|YP_001801768.    QPLLD--NDNLSQSWGIPWINNNKELKLSNTIHHPRLLN-----AGWLLE
gi|86608324|ref|YP_477086.1|_C    P-EVRGVLREMRGKWGIPWADRQ------NLRYHPRLLN-----AGWLVE
gi|86607166|ref|YP_475929.1|_C    P-GMREVIREMRGKWGIPWADQQ------NLRYHPRLLN-----AGWLVE
gi|255256456|ref|ZP_05335917.1    LRQIQVKPLNKIEGDFNNVVNIEG------EWFFEENLC-----TENIKK
gi|209526382|ref|ZP_03274910.1    GKTSQEYQDFLAQTRGRPFHIPKTDICINRQNLPGRYYNGVMFSSKWLAE
gi|162453956|ref|YP_001616323.    TSFVRSLRSLAEAAQRADGAGLRFLEYEAELTVFPEVLAAAEERAPEGGG
                                                                                    .

gi|121997427|ref|YP_001002214.    WVE--------------------------------QQRESDDGDETAARQ
gi|88810314|ref|ZP_01125571.1|    WIE--------------------------------AQR--DEGKAEAAIS
gi|255254649|ref|ZP_05334193.1    YDFN-------------------------------SKRLGKLKELLKSID
gi|255338062|ref|ZP_05378933.1    YDFK-------------------------------SKRLGELKELLKSID
gi|20808984|ref|NP_624155.1|_h    EHTE-------------------------------NFKVEEFQKMSQKIT
gi|254478158|ref|ZP_05091540.1    EHTE-------------------------------NFKVEEFQKMSQKIT
gi|38505758|ref|NP_942378.1|_h    ELED-------------------------------LDQTELPSYRQALQTE
gi|170079601|ref|YP_001736234.    ELEN-------------------------------LDKEAQKVYRQDLQNE
gi|126661502|ref|ZP_01732553.1    DLE---------------------------------KESTAENRLKLQKL
gi|172035267|ref|YP_001801768.    DVEISHDSNI--------------------EYREKLEELSTKRTTIQQV
gi|86608324|ref|YP_477086.1|_C    DLEL-------------------------------DEETQRSYRQDIETL
gi|86607166|ref|YP_475929.1|_C    DLEA-------------------------------DEATQKRCRQEIEAT
gi|255256456|ref|ZP_05335917.1    QFG---------------------------------IEIDDKEIEDLRKSL
gi|209526382|ref|ZP_03274910.1    DMGLE------------------------------KEQRPELRKIVDLTH
gi|162453956|ref|YP_001616323.    REQGDGAAQRGGLRDRDGKRVPRSKVEALRRAVESLRRAAKELDRPAGSA gi|121997427|ref|YP_001002214.    AIRKVTGTEAEAYYALLLMDGDRMGAWLSGGDGTTIPYRAAFHP------
gi|88810314|ref|ZP_01125571.1|    RLAHALGYKPETYYALLLMDGDYMGAWLSGDERFTIPYRAAFHP------
gi|255254649|ref|ZP_05334193.1    KRIKDIRLNKKKYYAVIKLDGDNMGKWLAGE--LAPYMLEMYHS------
gi|255338062|ref|ZP_05378933.1    KRIKDIRLNKKKYYAVIKLDGDNMGKWLAGE--LAPYMLEMYHS------
gi|20808984|ref|NP_624155.1|_h    KLLEKHRVNPSRYYAILQMDGDHMGKWLKGE--NNPPIMETLHP------
gi|254478158|ref|ZP_05091540.1    KLLEKHRVNPSRYYAILQMDGDHMGKWLKGE--NNPPIMETLHP------
gi|38505758|ref|NP_942378.1|_h    IEKFYPQNNPTSWYVLAAGDGDGMSEWLKGTKMRTYGDYFPQVL------
gi|170079601|ref|YP_001736234.    IQKFYPQNNPASWYAIAAGDGDGMSDWLKGTKMEAYKEYFPKAL------
gi|126661502|ref|ZP_01732553.1    VKDYYPSNNPTDCYIIAAGDGDGMSEWLKGGKLKSYGHYTPENL------
gi|172035267|ref|YP_001801768.    INKYYPSNNPTNWYILVAGDGDSMRDWLRGSKLKNYGEYLPDELREKI--
gi|86608324|ref|YP_477086.1|_C    LGRYYPSVNPASWYVLAAGDGDDMGKWLRGEKMKSYYDYLPQPLQRLANG
gi|86607166|ref|YP_475929.1|_C    LSRYYPSINPASWYVLAAGDGDDMGQWLSGGKMKPYYDYLPQPLQRLADG
gi|255256456|ref|ZP_05335917.1    KQITDKVGEPNPYYAVVLFDGDNMGEWLAGKLLHNFEHIYGSDLWN----
gi|209526382|ref|ZP_03274910.1    SECGFGDSSPTDWWVMILGDGDGMGQYVSGKKLHPYQEYLTETHPETFID
gi|162453956|ref|YP_001616323.    RRAGDRIPAPGSQVALIALDGDRISQILLGEKIGARWRDVIHPE------
                                                :  ***  :  : *
```

FIGURE 9 (continued)

```
gi|121997427|ref|YP_001002214.    -------------DLADAVDTRFGDHTVLQAYLDTPRAVSPARHLAISGA
gi|88810314|ref|ZP_01125571.1|    -------------KIQAGLQARFQDNSPLDDYLNAQRAVSPGRHLAISGA
gi|255254649|ref|ZP_05334193.1    -------------KLQGFLPEDFKEKIK-----DKKRLMTPAVHSLISEA
gi|255338062|ref|ZP_05378933.1    -------------KLQGFLPEDFKEKIK-----DKKRLMTPAVHSLISEA
gi|20808984|ref|NP_624155.1|_h    -------------KVGEHIKQHAKDNLSS--ILCKKHPTTPSLHQTLSRK
gi|254478158|ref|ZP_05091540.1    -------------KVGEHIKQHAKDNLSS--ILCKKHPTTPSLHQTLSRK
gi|38505758|ref|NP_942378.1|_h    -------------TVPEDLQPTFQPFSE------QPKRMGPATHNALSRA
gi|170079601|ref|YP_001736234.    -------------NVPNDLKKSFDKFSD------EAKRMGPATHNALSRA
gi|126661502|ref|ZP_01732553.1    -------------NVEGDIAEAFNEFLT------VPKRMGPSTHNALSRA
gi|172035267|ref|YP_001801768.    --------INDSNDEIPKEYKEPLQNFLE------VRKRMGPSTHSALSRA
gi|86608324|ref|YP_477086.1|_C    QTEAIGEVFGKDKEELEQVKDAFQKFVKN-----SRKRMGPATHSALSRA
gi|86607166|ref|YP_475929.1|_C    QRDAIGRVLDS--EELKQVKDAFSEFVKA-----SRKRMGPATHSALSRA
gi|255256456|ref|ZP_05335917.1    -------------KLPNKVKEELKTSIKN-------KLLAPTIHSLISLS
gi|209526382|ref|ZP_03274910.1    RDRYPDLDENQYEQKKRQFIKAFRDDKHS--LLKTRKRMGPATHVGLNRA
gi|162453956|ref|YP_001616323.    -------------AVATMESNEVTRAARWPELLGRKRLMGPSTHAFVNRV
                                                                :   *  *   :.

gi|121997427|ref|YP_001002214.    LNDFSTTLARRVVEECHHGRVLYAGGDDLMAMLPTGDLLSAMRELRDAYS
gi|88810314|ref|ZP_01125571.1|    LNDFSTVIAREVVEREHIGRVLYAGGDDLMAMFAVSDLLSAMRRLRLAYS
gi|255254649|ref|ZP_05334193.1    LKNYSLKYVKEIVEETRAGKVIYSGGDDVFAIVNLNYLLDVMVKLRAAFS
gi|255338062|ref|ZP_05378933.1    LKNYSLKYVKEIVEETRAGKVIYSGGDDVFAIVNLNYLLDVMVKLRAAFS
gi|20808984|ref|NP_624155.1|_h    ISTFALQEVRRIVEETHYGKLVYAGGDDVLALLPVEEVLECAYELQNAFK
gi|254478158|ref|ZP_05091540.1    ISTFALQEVQRIVEETHYGKLVYAGGDDVLALLPVEEVLECAYELQNAFK
gi|38505758|ref|NP_942378.1|_h    LLDFSNQLVPYLTEQRYAGRLIYSGGDDVLAYTNLWEWDQWLWDIRQAFR
gi|170079601|ref|YP_001736234.    LLDFSNKLAPYLTEERYAGRLIYSGGDDVLAYTNLWEWDQWLWDIRQAFR
gi|126661502|ref|ZP_01732553.1    LLDFSNQLVPYLTEQRYAGRLIYSGGDDVLAYTNLWEWDNWLWDIRQCFR
gi|172035267|ref|YP_001801768.    LLDFSNQLVPYLTEQRYAGRLIYSGGDDVLAYTNLWEWDNWLWDIRQCFK
gi|86608324|ref|YP_477086.1|_C    LLDFSGQLVPYLTEQRYAGKLIYAGGDDVLAYTNLWEWDGWLWDIRQCFR
gi|86607166|ref|YP_475929.1|_C    LLDFSGQLVPYLTEQRYAGRLIYAGGDDVLAYTNLWEWDGWLWDIRQCFR
gi|255256456|ref|ZP_05335917.1    LRNYSLEFVKKIVEDDHLGKLIYSGGDDVLAFVNLKDLFEVMRRLRAAFS
gi|209526382|ref|ZP_03274910.1    LLDFSNRLVPFITEKRFCGRVVYSGGDDVMTVLPLEDLPDYLLSRAAWC
gi|162453956|ref|YP_001616323.    LAEFAHTIVPWVVEREFSGRLIYAGGDDVLAIAPAGEALDLCARLAQLYS
                                  :  ::   .    :.*    *::::*:****:::           :  :

gi|121997427|ref|YP_001002214.    GTATSG--------------------------------------------
gi|88810314|ref|ZP_01125571.1|    GLAPEE--------------------------------------------
gi|255254649|ref|ZP_05334193.1    GHLIVN--------------------------------------------
gi|255338062|ref|ZP_05378933.1    GHLIVN--------------------------------------------
gi|20808984|ref|NP_624155.1|_h    EVLSS---------------------------------------------
gi|254478158|ref|ZP_05091540.1    EVLSS---------------------------------------------
gi|38505758|ref|NP_942378.1|_h    GDRD-------------------------------------------E
gi|170079601|ref|YP_001736234.    GDKD-------------------------------------------D
gi|126661502|ref|ZP_01732553.1    GDKDPLGFNNDG-------------------------------TFNLE
gi|172035267|ref|YP_001801768.    GQED-------------------------------------------P
gi|86608324|ref|YP_477086.1|_C    GGED-------------------------------------------D
gi|86607166|ref|YP_475929.1|_C    GGED-------------------------------------------D
gi|255256456|ref|ZP_05335917.1    GHIKIE--------------------------------------------
gi|209526382|ref|ZP_03274910.1    GGDDPYQPQAG---------------------------------DPD
gi|162453956|ref|YP_001616323.    AAWVLDTSPGEGPWAWRAKTWTSSTSIRASERFVVAPSETGEPLPWPIP
```

FIGURE 9 (continued)

```
gi|121997427|ref|YP_001002214.    ------EAEEEDAWCRNGFIYRQDRLYLTMGSQATASMGAVIAHHKTPLT
gi|88810314|ref|ZP_01125571.1|    ------GEAAHEMRFQNGFARRRGRLYLTMGENATASMGAVIAHHQAPLG
gi|255254649|ref|ZP_05334193.1    ------NEIIPDFTIDAGFVERKEEIDVMMGNKATASMGVVIAHYKEDLK
gi|255338062|ref|ZP_05378933.1    ------NKIIPDFTIDAGFVERKEEIDVMMGNKATASMGVVIAHYKEDLK
gi|20808984|ref|NP_624155.1|_h    -------------------------------EASMSAGIVIVHHKYPLY
gi|254478158|ref|ZP_05091540.1    -------------------------------EASMSAGIVIVHHKYPLY
gi|38505758|ref|NP_942378.1|_h    HREFDSTGHYWHSKTAHKN--LPQRPLFTMGDGATISFGITIAHHSVPLA
gi|170079601|ref|YP_001736234.    CGEFNNQGHYWQADRFDR-------PLFTMGKNATISFGLVIAHHSVPLA
gi|126661502|ref|ZP_01732553.1    KSEFKNEGNYWQWNQENKPNHLAERPLFTMGQNATISFGIVIAHHSVPLA
gi|172035267|ref|YP_001801768.    YNEFKNEGDYWQWNKPNKPKNIAQRPLFTMGKCATISFGIVIAHHSIPLA
gi|86608324|ref|YP_477086.1|_C    WREFENLGDYWQWKKGRPPEGLSRRPLFTLGSAATISFGVVIAHHSVPLA
gi|86607166|ref|YP_475929.1|_C    WREFANEGDYWQWQKAQLPAGLSRRPLFTLGSLASISFGVVIAHHSVPLA
gi|255256456|ref|ZP_05335917.1    -----NNEIKVDWSNNTGFVEKDGKLLLTMCKNATASCGVVIAHYKTPLK
gi|209526382|ref|ZP_03274910.1    LKFQSQGGYWRPTSDTNDFQGLPDRSLFTMGFGATMSLGIVIVDKSVPLP
gi|162453956|ref|YP_001616323.    EASRRGPIPAGDAAAASAAESAEERLLPMMGAGQTLSAGIAIGHYKTSLG
                                                :  *  * .*  . .            * gi|121997427|ref|YP_001002214.    AALAELRQAEQRAKNE----------------------------------
gi|88810314|ref|ZP_01125571.1|    AVLRALRGAEKTAKAYNR--------------------------------
gi|255254649|ref|ZP_05334193.1    NVIASVDEVEEEYAKKVE--------------------------------
gi|255338062|ref|ZP_05378933.1    NVIASVDEVEEEYAKKVE--------------------------------
gi|20808984|ref|NP_624155.1|_h    LALKEVQLAQKKAKDERQ--------------------------------
gi|254478158|ref|ZP_05091540.1    LALKEVQLAQKKAKDERQ--------------------------------
gi|38505758|ref|NP_942378.1|_h    IALEHLWEAEEEAKEHEYGEGED---------------------------
gi|170079601|ref|YP_001736234.    IALENLWEAEEGAKDHEYEDFALEGKER----------------------
gi|126661502|ref|ZP_01732553.1    IALENLWEAEEEAKEHYINENNH---------------------------
gi|172035267|ref|YP_001801768.    IALESLWEAEEEAKEHYTQKDNK---------------------------
gi|86608324|ref|YP_477086.1|_C    IALENLWQAEEEAKGHLYAHGCP---------------------------
gi|86607166|ref|YP_475929.1|_C    IALENLWEAEQGAKEQAYAQGSS---------------------------
gi|255256456|ref|ZP_05335917.1    MVMDKVRETEKKAKSNTE--------------------------------
gi|209526382|ref|ZP_03274910.1    VALEALWEAESDRAKELSGGLLMSIDLLRGLTEWRSLSLMRFVLSEIFRL
gi|162453956|ref|YP_001616323.    GLVKAAWDERDRVKGEDEERDCAKEDNEE-----RIRVKGDDEERDRATR
                                         :              ..

gi|121997427|ref|YP_001002214.    ---GGRDAFALSVLKRSGGALRHVGRWAPAAGIDEMSALRDFAEA---LH
gi|88810314|ref|ZP_01125571.1|    ---GSRDAFSLTIIKRAGGALELTLPWQMGG-EDVIGALRTLSAA---LQ
gi|255254649|ref|ZP_05334193.1    ---G-KDAFAIKLILHSGENYIARAKWNYDDARNKEGTIGLLKDI---NS
gi|255338062|ref|ZP_05378933.1    ---G-KDAFAIKLILHSGENYIARAKWNYDDARNKEGTIGLLKDI---NS
gi|20808984|ref|NP_624155.1|_h    ---YNRNAFCLKFIKGSG---------ALKECGGKWALMDFLREL---IE
gi|254478158|ref|ZP_05091540.1    ---YNRNAFCLKFIKGSG---------ALKECGGKWALMDFLRGL---IE
gi|38505758|ref|NP_942378.1|_h    --KKSKDAVQVRVIYGNGNVLTATSKFEVFKTWKDLLDIET---------
gi|170079601|ref|YP_001736234.    --KKKKDAVQLRVIYGNGNILKATCKFDTFRAWQQLLEITG---------
gi|126661502|ref|ZP_01732553.1    --KTYKDAVQVRVIYGNGNILKATSKFEVFEQWKKLLRINE---------
gi|172035267|ref|YP_001801768.    --DTYKDAVQVRVLYGNGNTLKSTKFDIFNQWKQLLKLD-----------
gi|86608324|ref|YP_477086.1|_C    -----KDSVQVRVLFANGNQLVSTSKFDTFDKWKDLLDFDWKLMG---QQ
gi|86607166|ref|YP_475929.1|_C    -----KDSAQVRVLFANGNQLVSTCKFDTFDKWKDLLDFDWKLLG---QK
gi|255256456|ref|ZP_05335917.1    -----KDSFAISLLKRSGEEKIIVSKWKYGDMDVLEILKELSYLF---RR
gi|209526382|ref|ZP_03274910.1    SSVPNKNGLCFRVLYSSGNTLEALIKGELYAGWRDWITTEHHQALSSLLY
gi|162453956|ref|YP_001616323.    EDLAVKNAFSIRRYTRGGEKARLRLSWGRRCAAPGKALAGYLRVKAVIEG
                                     ::.  .          *
```

FIGURE 9 (continued)

```
gi|121997427|ref|YP_001002214.    ANPEASRRAAYNVAGWLADLPEPDTLPPEDGVAGYLEAVLHYQFCRQGLE
gi|88810314|ref|ZP_01125571.1|    KNAGASRRAAYNVRGWLRDLPKPVAVGGEAPFRRLLGQMLHYQFQRQKLE
gi|255254649|ref|ZP_05334193.1    FFKEDKLSISFVGKLKAALERLDVDSLPQGIFISELKRNIKRSLNENLSK
gi|255338062|ref|ZP_05378933.1    FFKEDKLSISFVGKLKAALERLDVDSLPQGIFISELKRNIKRSLNENLSK
gi|20808984|ref|NP_624155.1|_h    HFKKGEFSSTFPYQFFEVVDRLYDDENKEQIIGILRNELKRIFLRQSGNR
gi|254478158|ref|ZP_05091540.1    HFKKGEFSSTFPYQFFEVVDRLYDDENKEQVIGILRNELKRIFLRQSGNR
gi|38505758|ref|NP_942378.1|_h    -IDASTYETAATVLEQHPIPVREAIMPWVNVLVERRDALDKDQQS--TLR
gi|170079601|ref|YP_001736234.    -LEASTFETAATLLEQHPIPTSVAIAPWVSAFVERRSNLNEEQKI--GLQ
gi|126661502|ref|ZP_01732553.1    -LEASLFEQAATLWTQHPIPIQEAIKPWTVAFCSRRETLNDDIRK--SFQ
gi|172035267|ref|YP_001801768.    -LEPSLFEQAATIWEQHPIPDKSAIEPWTKAFCSRRD-IGEELQQ--DYQ
gi|86608324|ref|YP_477086.1|_C    QDQSSLFEQAAQLWEQHPAPSPEAVPAWATLFCSRRDLFKQESEQKEHFQ
gi|86607166|ref|YP_475929.1|_C    QDQSSLFEHAAQLWEQHPAPSLEAVPAWARLFCSRRDLFHGESEQTDRFQ
gi|255256456|ref|ZP_05335917.1    NQSGVRISRRIVYTLAEEFAKLKDKCGNYIAETGIINTEIKRVVLRAVDT
gi|209526382|ref|ZP_03274910.1    RLAEELPRHADLTPSSYLIAQAARAIALRRDDKDLVQENIDKLLIWLRYW
gi|162453956|ref|YP_001616323.    FKTGALPGRLPYKLREVEGAVLAAWLVEAKALPGGLTSREARRELVKRVE gi|121997427|ref|YP_001002214.    QQGQPIHARRLGSLASVSPTGDELSSAAKIRDRLSHLVGVAEFLARETRR
gi|88810314|ref|ZP_01125571.1|    KEGAPIHAERLAKLCPVENP-------AKAADFIENMLSVAEFLARETRS
gi|255254649|ref|ZP_05334193.1    DEKEKVERDLYILLYSLYKE--------VKYDNFISLLTILAFLNRGGEK
gi|255338062|ref|ZP_05378933.1    DEKEKVERDLYILLYSLYKE--------VKYDNFISLLTILAFLNRGGEK
gi|20808984|ref|NP_624155.1|_h    DILEKYASEILLPKFDEIVK--------ETPDRVIDFANMLIIARSIAME
gi|254478158|ref|ZP_05091540.1    DILEKYASEILLPKFDEIVK--------ETPDRVIDFANMLIIARSIAME
gi|38505758|ref|NP_942378.1|_h    SRLACFLIQLWQTTSQKN----------WEKEAKNWLKVAAFMKRNRYI
gi|170079601|ref|YP_001736234.    KYLAHFLQELWNTTNADD----------WDKESKNWLKAAAFNLRTRKV
gi|126661502|ref|ZP_01732553.1    TALSKFIEDLWTNTSEEQ----------LNQDVQSWFKLTAFVLRNRKI
gi|172035267|ref|YP_001801768.    KILTSFIQGLWITTPQNN----------LDKEVKNWLKLAAFVKRNRKI
gi|86608324|ref|YP_477086.1|_C    NKLVEFIQHFWQHSLPAQPQ--------EWDLEIKNWFKLAAFVLRNRTV
gi|86607166|ref|YP_475929.1|_C    TKLVEFIQHFWQHSLPAQPG--------AWDLAIKNWFKLAAFVLRNRTV
gi|255256456|ref|ZP_05335917.1    VSGNIGKEEKKNISKEISDVLKN--LYHKYDDDIDNFLKLIEISAFIGKE
gi|209526382|ref|ZP_03274910.1    EDWARSVHVQWLIDREKNPDTPKPIG--IDLKDLSNILRFSAFWLDKMQQ
gi|162453956|ref|YP_001616323.    PFARGLFGAQCAAEVEGAFEIWWQGLLSALRAHERRWRAPDAVPPGATPV gi|121997427|ref|YP_001002214.    ---------------------------------
gi|88810314|ref|ZP_01125571.1|    LDT------------------------------
gi|255254649|ref|ZP_05334193.1    ---------------------------------
gi|255338062|ref|ZP_05378933.1    ---------------------------------
gi|20808984|ref|NP_624155.1|_h    HSCNE----------------------------
gi|254478158|ref|ZP_05091540.1    ARI------------------------------
gi|38505758|ref|NP_942378.1|_h    KFPN-----------------------------
gi|170079601|ref|YP_001736234.    ---------------------------------
gi|126661502|ref|ZP_01732553.1    KLGGKA---------------------------
gi|172035267|ref|YP_001801768.    SLNQE----------------------------
gi|86608324|ref|YP_477086.1|_C    KLGRNGR--------------------------
gi|86607166|ref|YP_475929.1|_C    TLGRNGR--------------------------
gi|255256456|ref|ZP_05335917.1    GE-------------------------------
gi|209526382|ref|ZP_03274910.1    RQQWHRQDQEA----------------------
gi|162453956|ref|YP_001616323.    DDGAPSRGLGSEQGLAVCRFLGALARGEEDAQ
```

FIGURE 9 (continued)

PLANTS HAVING ENHANCED YIELD-RELATED TRAITS RESULTED FROM MODULATED EXPRESSION OF A SGT1 POLYPEPTIDE AND A METHOD FOR MAKING THE SAME

RELATED APPLICATIONS

This application is a national stage application (under 35 U.S.C. §371) of PCT/EP2010/064095, filed Sep. 24, 2010 which claims benefit of European Application No. 09171385.9, filed Sep. 25, 2009; European Application No. 09171364.4, filed Sep. 25, 2009; U.S. Provisional Application No. 61/252,220, filed Oct. 16, 2009; U.S. Provisional Application No. 61/252,215, filed Oct. 16, 2009; U.S. Provisional Application No. 61/260,942, filed Nov. 13, 2009; and European Application No. 09175989.4, filed Nov. 13, 2009.

Submission of Sequence Listing

The Sequence Listing associated with this application is filed in electronic format via EFS-Web and hereby incorporated by reference into the specification in its entirety. The name of the text file containing the Sequence Listing is Sequence_Listing_074021_0175. The size of the text file is 627 KB and the text file was created on Sep. 21, 2015.

The present invention relates generally to the field of molecular biology and concerns a method for enhancing yield-related traits in plants by modulating expression in a plant of a nucleic acid encoding an SGT1 polypeptide, or a CLC-pKG polypeptide, or a HD-hydrolase-like polypeptide. The present invention also concerns plants having modulated expression of a nucleic acid encoding an SGT1 polypeptide, or a CLC-pKG polypeptide, or a HD-hydrolase-like polypeptide, which plants have enhanced yield-related traits relative to corresponding wild type plants or other control plants. The invention also provides constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (Zea mays L.) hybrids based on Corn Belt germplasm in the European Atlantic.

A further important trait is that of improved abiotic stress tolerance. Abiotic stress is a primary cause of crop loss worldwide, reducing average yields for most major crop plants by more than 50% (Wang et al., Planta 218, 1-14, 2003). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle or various signalling pathways involved in plant growth or in defence mechanisms.

It has now been found that various yield-related traits may be improved in plants by modulating expression in a plant of a nucleic acid encoding an an SGT1 polypeptide, or a CLC-pKG polypeptide, or a HD-hydrolase-like polypeptide, in a plant.

BACKGROUND

1. SGT1 Polypeptides

SGT1 is known as a suppressor allele of skp1 mutant.

Chung et al., 2006 report that SGT1 plays a crucial role in developmental processes. SGT1 has unique domains necessary for protein functions: tetratricopeptide repeat domain (TPR), CHORD and SGT1 motif (CS) and SGT1-specific motif (SGS motif). The TPR domain has been known to mediate protein-protein interactions among multicomplex proteins functioning as chaperone, cell cycle, transcription, or protein transport complexes. For example, the TPR domain of SGT1 was shown to bind to heat-shock protein 70 (HSP70). However, the CS domain of SGT1 is similar to the one in the human p23 protein, which is known to interact with HSP90 and participate in the folding of different regulatory proteins.

2. CLC-pKG Polypeptides

In both prokaryotic and eukaryotic organism, anion channels/transporters appear as key players in the control of metabolism, in the maintenance of electrochemical gradients and in signalling pathways leading to adaptation to abiotic and biotic environmental stresses. In plants, they contribute to various physiological functions such as control of stomatal movements regulating gas exchanges in leaves, plant-pathogen interaction, root xylem loading, compartmentation of metabolites and coupling with proton gradients (reviewed in De Angeli et al. 2007 Phil. Trans. R. Soc. B 2009 364, 195-201). Anion channel activities and associated regulation mechanisms have been characterized primarily using electrophysiological techniques. They were reported in all plant membranes including the plasma membrane, tonoplast, endoplasmic reticulum, mitochondria and chloroplasts, plasma membrane channels being by far the best characterized compared to those located on other membranes. In model plants such as rice and *Arabidopsis* there are up to seven genes encoding CLCs which are spread in over two distinct subfamilies (Marmagne et al. 2007, Journal of Experimental Botany, Vol. 58, No. 12, pp. 3385-3393). One of such subfamilies comprising the AtCLCe and AtCLCf proteins is close to the prokaryotic CLC, altogether belonging to the Chloride Channel Prokayotic Group while the other class is closer to the eukatyotic CLCs. The *Arabidopsis thaliana* AtCLCf protein is reported to have similar subcellular distribution and presumably similar function as those CLCs of *Synechocystis* CLC, considered to represent the ancestor precursor of plant chloroplast.

Nitrate and malate represent the majority of anions in a plant cell. Nitrate is a nutrient but can act as a signalling molecule as well. Plants have a sophisticated nitrate uptake system involving both low- and high-affinity transporters, nitrate is next either transported through the xylem to enter into the cellular metabolism or is stored locally. Cells assimilate nitrate via the nitrate reductase pathway or store it in the tonoplast, and a dynamic balance exists between cytosolic and vacuolar nitrate levels, regulated by uptake of extracellular nitrate, storage in the vacuole and anabolism. The discovery of the chloride channel (CLC) family allowed unravelling the mechanism of proton/nitrate exchange between tonoplasts and cytosol. Determination of subcellular localization, expression patterns, and characterization of knockout mutant phenotypes, gave insight in the physiological role of CLC proteins. Phenotypic analyses showed that cica-1 and cica-2 mutant plants have a reduced nitrate compared to that of wild-type in root and shoot tissues. Also cicc and cice mutants showed lower nitrate levels compared to control plants. An overview of the art is provided by De Angeli et al., Phil. Trans. R. Soc. B 364, 195-201, 2009; and the references cited therein. However, still little is know about the precise role of CLC proteins, and the effect of overexpressing CLC genes on plant phenotypes.

3. HD-Hydrolase-Like Polypeptides

The HD domain comprises a sequence of two small amino acids, followed by two hydrophobic amino acids, a histidine and an aspartic acid, again a hydrophobic amino acid, a small amino acid and a charged amino acid. Because of its weak sequence conservation, it was only recently discovered (Aravind and Koonin, Trends in Biochemical Sciences, 23: 469-472, 1998). The domain is reportedly present in metal-dependent phosphohydrolases, including nucleic acid polymerases and helicases (Aravind and Koonin, 1998). Although the HD-domain comprising proteins are predicted to exhibit phosphohydrolase activity and appears to be involved in nucleic acid metabolism or in signal transduction (Galperin et al., J. Mol. Microbiol. Biotechnol. 1, 303-305, 1999), the precise biological role of the HD domain remains to be elucidated.

SUMMARY

1. SGT1 Polypeptides

Surprisingly, it has now been found that modulating expression of a nucleic acid encoding an SGT1 polypeptide gives plants having enhanced yield-related traits, in particular increased seed yield relative to control plants.

According to one embodiment of the present invention, there is provided a method for improving yield-related traits in plants relative to control plants, comprising modulating expression in a plant of a nucleic acid encoding an SGT1 polypeptide.

2. CLC-pKG Polypeptides

Surprisingly, it has now been found that modulating expression of a nucleic acid encoding a CLC-pKG polypeptide gives plants having enhanced yield-related traits relative to control plants.

According one embodiment, there is provided a method for enhancing or improving yield-related traits in plants relative to control plants, comprising modulating expression in a plant of a nucleic acid encoding a CLC-pKG polypeptide.

3. HD-Hydrolase-Like Polypeptides

Surprisingly, it has now been found that modulating expression of a nucleic acid encoding a HD-hydrolase-like polypeptide gives plants having enhanced yield-related traits, in particular increased yield relative to control plants.

According one embodiment, there is provided a method for improving yield-related traits in plants relative to control plants, comprising modulating expression in a plant of a nucleic acid encoding a HD-hydrolase-like polypeptide.

Definitions

The following definitions will be used throughout the present specification.

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions | Residue | Conservative Substitutions |
|---|---|---|---|
| Ala | Ser | Leu | Ile; Val |
| Arg | Lys | Lys | Arg; Gln |
| Asn | Gln; His | Met | Leu; Ile |
| Asp | Glu | Phe | Met; Leu; Tyr |
| Gln | Asn | Ser | Thr; Gly |
| Cys | Ser | Thr | Ser; Val |
| Glu | Asp | Trp | Tyr |
| Gly | Pro | Tyr | Trp; Phe |
| His | Asn; Gln | Val | Ile; Leu |
| Ile | Leu, Val | | |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain, Motif/Consensus Sequence/Signature

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Methods for the alignment of sequences for comparison are well known in the art, such methods include GAP, BEST-FIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

Reciprocal BLAST

Typically, this involves a first BLAST involving BLASTing a query sequence (for example using any of the sequences listed in Table A of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The $T_m$ is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The $T_m$ may be calculated using the following equations, depending on the types of hybrids:

1) DNA-DNA hybrids (Meinkoth and Wahl, Anal. Biochem., 138: 267-284, 1984):
   $T_m = 81.5°$ C. $+16.6 \times \log_{10}[Na^+]^a + 0.41 \times \%[G/C^b] - 500 \times [L^c]^{-1} - 0.61 \times \%$ formamide 2) DNA-RNA or RNA-RNA hybrids:
   $T_m = 79.8°$ C. $+18.5 (\log_{10}[Na^+]^a) + 0.58 (\% G/C^b) + 11.8 (\% G/C^b)^2 - 820/L^c$ 3) oligo-DNA or oligo-RNAs hybrids:
   For <20 nucleotides: $T_m = 2 (l_n)$
   For 20-35 nucleotides: $T_m = 22 + 1.46 (l_n)$

[a] or for other monovalent cation, but only accurate in the 0.01-0.4 M range.

[b] only accurate for % GC in the 30% to 75% range.

[c] L=length of duplex in base pairs.

[d] oligo, oligonucleotide; $l_n$=effective length of primer=2×(no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3$^{rd}$ Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Construct

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
|---|---|
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100:456-462, 1997 |
| GOS2 | de Pater et al, Plant J Nov;2(6):837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231:276-285, 1992 |
| Alfalfa H3 histone | Wu et al. Plant Mol. Biol. 11:641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20):7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
|---|---|
| RCc3 | Plant Mol Biol. 1995 January; 27(2):237-48 |
| Arabidopsis PHT1 | Koyama et al. J Biosci Bioeng. 2005 January; 99(1): 38-42.; Mudge et al. (2002, Plant J. 31: 341) |
| Medicago phosphate transporter | Xiao et al., 2006, Plant Biol (Stuttg). 2006 Jul; 8(4): 439-49 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U. S. Pat. No. 5, 401, 836 |
| SbPRP1 | Suzuki et al., Plant Mol. Biol. 21: 109-119, 1993. |
| LRX1 | Baumberger et al. 2001, Genes & Dev. 15:1128 |
| BTG-26 Brassica napus | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 17 (6): 1139-1154 |
| KDC1 (Daucus carota) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (Arabidopsis) | Diener et al. (2001, Plant Cell 13: 1625) |
| NRT2;1Np (N. plumbaginifolia) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
|---|---|
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Plant Mol. Biol. 12: 15-22, 1986); Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |

TABLE 2c-continued

Examples of seed-specific promoters

| Gene source | Reference |
|---|---|
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| sorghum α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d examples of endosperm-specific promoters

| Gene source | Reference |
|---|---|
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol ,Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| sorghum kafirin | DeRose et al. (1996) Plant Mol Biol 32: 1029-35 |

TABLE 2e

Examples of embryo specific promoters:

| Gene source | Reference |
|---|---|
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

Examples of aleurone-specific promoters

| Gene source | Reference |
|---|---|
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38,1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

Examples of green tissue-specifc promoters

| Gene | Expression | Reference |
|---|---|---|
| Maize Orthophosphate dikinase | Leaf specific | Fukayama et al., Plant Physiol. 2001 Nov; 127(3): 1136-46 |
| Maize Phosphoenolpyruvate carboxylase | Leaf specific | Kausch et al., Plant Mol Biol. 2001 Jan; 45(1): 1-15 |
| Rice Phosphoenolpyruvate carboxylase | Leaf specific | Lin et al., 2004 DNA Seq. 2004 Aug; 15(4): 269-76 |
| Rice small subunit Rubisco | Leaf specific | Nomura et al., Plant Mol Biol. 2000 Sep; 44(1): 99-106 |
| rice beta expansin EXBP9 | Shoot specific | WO 2004/070039 |
| Pigeonpea small subunit Rubisco | Leaf specific | Panguluri et al., Indian J Exp Biol. 2005 Apr; 43(4): 369-72 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

Examples of meristem-specific promoters

| Gene source | Expression pattern | Reference |
|---|---|---|
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or (b) genetic control sequence(s) which is operably linked with the nucleic acid sequence according to the invention, for example a promoter, or (c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not present in, or originating from, the genome of said plant, or are present in the genome of said plant but not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

It shall further be noted that in the context of the present invention, the term "isolated nucleic acid" or "isolated polypeptide" may in some instances be considered as a synonym for a "recombinant nucleic acid" or a "recombinant polypeptide", respectively and refers to a nucleic acid or polypeptide that is not located in its natural genetic environment and/or that has been modified by recombinant methods.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. For the purposes of this invention, the original unmodulated expression may also be absence of any expression. The term "modulating the activity" shall mean any change of the expression of the inventive nucleic acid sequences or encoded proteins, which leads to increased yield and/or increased growth of the plants. The expression can increase from zero (absence of, or immeasurable expression) to a certain amount, or can decrease from a certain amount to immeasurable small amounts or zero.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level. For the purposes of this invention, the original wild-type expression level might also be zero, i.e. absence of expression or immeasurable expression.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. MiRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic [Feldman, K A and Marks M D (1987). Mol Gen Genet 208:1-9; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3): 425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

The genetically modified plant cells can be regenerated via all methods with which the skilled worker is familiar. Suitable methods can be found in the above-mentioned publications by S. D. Kung and R. Wu, Potrykus or Höofgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

TILLING

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offringa et al. (1990) EMBO J 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield Related Traits

Yield related traits are traits or features which are related to plant yield. Yield-related traits may comprise one or more of the following non-limitative list of features: early flowering time, yield, biomass, seed yield, early vigour, greenness index, increased growth rate, improved agronomic traits, such as e.g. improved Water Use Efficiency (WUE), improved Nitrogen Use Efficiency (NUE), etc.

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters.

The terms "yield" of a plant and "plant yield" are used interchangeably herein and are meant to refer to vegetative biomass such as root and/or shoot biomass, to reproductive organs, and/or to propagules such as seeds of that plant.

Taking corn as an example, male inflorescences (tassels) and female inflorescences (ears). The female inflorescence produces pairs of spikelets on the surface of a central axis (cob). Each of the female spikelets encloses two fertile florests, one of whose will usually mature into a maize kernel once fertilized. Hence a yield increase in maize may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate, which is the number of filled florets (i.e. florets containing seed) divided by the total number of florets and multiplied by 100), among others.

Inflorescences in rice plants are called panicles. The panicle bears spikelets. The spikelet is the basic unit of the panicles and consists of a pedicel and a floret. The floret is born on the pedicel. A floret includes a flower that is covered by two protective glumes: a larger glume (the lemma) and a shorter glume (the palea). Hence, taking rice as an example, a yield increase may manifest itself as an increase in one or more of the following: number of plants per square meter, number of panicles per plant, panicle length, number of spikelets per panicle, number of flowers (or florets) per panicle, increase in the seed filling rate which is the number of filled florets (i.e. florets containing seeds divided by the total number of floretsand multiplied by 100), increase in thousand kernel weight, among others. In rice, submergence tolerance may also result in increased yield.

Early Flowering Time

Plants having an "early flowering time" as used herein are plants which start to flower earlier than control plants. Hence this term refers to plants that show an earlier start of flowering. Flowering time of plants can be assessed by counting the number of days ("time to flower") between sowing and the emergence of a first inflorescence. The "flowering time" of a plant can for instance be determined using the method as described in WO 2007/093444.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increased Growth Rate

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination, early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

Stress Resistance

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35%, 30% or 25%, more preferably less than 20% or 15% in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. "Mild stresses" are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures.

"Biotic stresses" are typically those stresses caused by pathogens, such as bacteria, viruses, fungi, nematodes and insects.

The "abiotic stress" may be an osmotic stress caused by a water stress, e.g. due to drought, salt stress, or freezing stress. Abiotic stress may also be an oxidative stress or a cold stress.

"Freezing stress" is intended to refer to stress due to freezing temperatures, i.e. temperatures at which available water molecules freeze and turn into ice. "Cold stress", also called "chilling stress", is intended to refer to cold temperatures, e.g. temperatures below 10°, or preferably below 5° C., but at which water molecules do not freeze. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 97%, 95%, 92%, 90%, 87%, 85%, 83%, 80%, 77% or 75% of the average production of such plant in a given environment. Average production may be calculated on harvest and/or season basis. Persons skilled in the art are aware of average yield productions of a crop.

In particular, the methods of the present invention may be performed under non-stress conditions. In an example, the methods of the present invention may be performed under non-stress conditions such as mild drought to give plants having increased yield relative to control plants.

In another embodiment, the methods of the present invention may be performed under stress conditions.

In an example, the methods of the present invention may be performed under stress conditions such as drought to give plants having increased yield relative to control plants. In another example, the methods of the present invention may be performed under stress conditions such as nutrient deficiency to give plants having increased yield relative to control plants.

Nutrient deficiency may result from a lack of nutrients such as nitrogen, phosphates and other phosphorous-containing compounds, potassium, calcium, magnesium, manganese, iron and boron, amongst others.

In yet another example, the methods of the present invention may be performed under stress conditions such as salt stress to give plants having increased yield relative to control plants. The term salt stress is not restricted to common salt (NaCl), but may be any one or more of: NaCl, KCl, LiCl, $MgCl_2$, $CaCl_2$, amongst others.

In yet another example, the methods of the present invention may be performed under stress conditions such as cold stress or freezing stress to give plants having increased yield relative to control plants.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following:
(a) an increase in seed biomass (total seed weight) which may be on an individual seed basis and/or per plant and/or per square meter;
(b) increased number of flowers per plant;
(c) increased number of seeds;
(d) increased seed filling rate (which is expressed as the ratio between the number of filled florets divided by the total number of florets);
(e) increased harvest index, which is expressed as a ratio of the yield of harvestable parts, such as seeds, divided by the biomass of aboveground plant parts; and
(f) increased thousand kernel weight (TKW), which is extrapolated from the number of seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Biomass

The term "biomass" as used herein is intended to refer to the total weight of a plant. Within the definition of biomass, a distinction may be made between the biomass of one or more parts of a plant, which may include any one or more of the following:
aboveground parts such as but not limited to shoot biomass, seed biomass, leaf biomass, etc.;
aboveground harvestable parts such as but not limited to shoot biomass, seed biomass, leaf biomass, etc.;
parts below ground, such as but not limited to root biomass, etc.;
harvestable parts below ground, such as but not limited to root biomass, etc.;
vegetative biomass such as root biomass, shoot biomass, etc.;
reproductive organs; and
propagules such as seed.

Marker Assisted Breeding

Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Use as Probes in (Gene Mapping)

Use of nucleic acids encoding the protein of interest for genetically and physically mapping the genes requires only a nucleic acid sequence of at least 15 nucleotides in length. These nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acids encoding the protein of interest. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding the protein of interest in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana, Agropyron* spp., *Agrostis stolonifera, Allium* spp., *Amaranthus* spp., *Ammophila arenaria, Ananas comosus, Annona* spp., *Apium graveolens, Arachis spp, Artocarpus* spp., *Asparagus officinalis, Avena* spp. (e.g. *Avena sativa, Avena fatua, Avena byzantina, Avena fatua* var. *sativa, Avena hybrida*), *Averrhoa carambola, Bambusa* sp., *Benincasa hispida, Bertholletia excelsa, Beta vulgaris, Brassica* spp. (e.g. *Brassica napus, Brassica rapa* ssp. [canola, oilseed rape, turnip rape]), *Cadaba farinosa, Camellia sinensis, Canna indica, Cannabis sativa, Capsicum* spp., *Carex elata, Carica papaya, Carissa macrocarpa, Carya* spp., *Carthamus tinctorius, Castanea* spp., *Ceiba pentandra, Cichorium endivia, Cinnamomum* spp., *Citrullus lanatus, Citrus* spp., *Cocos* spp., *Coffea* spp., *Colocasia esculenta, Cola* spp., *Corchorus* sp., *Coriandrum sativum, Corylus* spp., *Crataegus* spp., *Crocus sativus, Cucurbita* spp., *Cucumis* spp., *Cynara* spp., *Daucus carota, Desmodium*spp., *Dimocarpus longan, Dioscorea* spp., *Diospyros* spp., *Echinochloa* spp., *Elaeis* (e.g. *Elaeis guineensis, Elaeis oleifera*), *Eleusine coracana, Eragrostis tef, Erianthus* sp., *Eriobotrya japonica, Eucalyptus* sp., *Eugenia uniflora, Fagopyrum* spp., *Fagus* spp., *Festuca arundinacea, Ficus carica, Fortunella* spp., *Fragaria* spp., *Ginkgo biloba, Glycine* spp. (e.g. *Glycine max, Soja hispida* or *Soja max*), *Gossypium hirsutum, Helianthus* spp. (e.g. *Helianthus annuus*), *Hemerocallis fulva, Hibiscus* spp., *Hordeum* spp. (e.g. *Hordeum vulgare*), *Ipomoea batatas, Juglans* spp., *Lactuca sativa, Lathyrus* spp., *Lens culinaris, Linum usitatissimum, Litchi chinensis, Lotus* spp., *Luffa acutangula, Lupinus* spp., *Luzula sylvatica, Lycopersicon* spp. (e.g. *Lycopersicon esculentum, Lycopersicon lycopersicum, Lycopersicon pyriforme*), *Macrotyloma* spp., *Malus* spp., *Malpighia emarginata, Mammea americana, Mangifera indica, Manihot* spp., *Manilkara zapota, Medicago sativa, Melilotus* spp., *Mentha* spp., *Miscanthus sinensis, Momordica* spp., *Morus nigra, Musa* spp., *Nicotiana* spp., *Olea* spp., *Opuntia* spp., *Ornithopus* spp., *Oryza* spp. (e.g. *Oryza sativa, Oryza latifolia*), *Panicum miliaceum, Panicum virgatum, Passiflora edulis, Pastinaca sativa, Pennisetum* sp., *Persea* spp., *Petroselinum crispum, Phalaris arundinacea, Phaseolus* spp., *Phleum pratense, Phoenix* spp., *Phragmites australis, Physalis* spp., *Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum rhabarbarum, Ribes* spp., *Ricinus communis, Rubus* spp., *Saccharum* spp., *Salix* sp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trifolium* spp., *Tripsacum dactyloides, Triticosecale rimpaui, Triticum* spp. (e.g. *Triticum aestivum, Triticum durum, Triticum turgidum, Triticum hybernum, Triticum macha, Triticum sativum, Triticum monococcum* or *Triticum vulgare*), *Tropaeolum minus, Tropaeolum majus, Vaccinium* spp., *Vicia* spp., *Vigna* spp., *Viola odorata, Vitis* spp., *Zea mays, Zizania palustris, Ziziphus* spp., amongst others.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

DETAILED DESCRIPTION OF THE INVENTION

Surprisingly, it has now been found that modulating expression in a plant of a nucleic acid encoding an SGT1 polypeptide gives plants having enhanced yield-related traits relative to control plants. According to a first embodiment, the present invention provides a method for enhancing yield-related traits in plants relative to control plants, comprising modulating expression in a plant of a nucleic acid encoding an SGT1 polypeptide and optionally selecting for plants having enhanced yield-related traits.

The invention also provides hitherto unknown SGT1-encoding nucleic acids and SGT1 polypeptides useful for conferring enhanced yield-related traits in plants relative to control plants.

Furthermore, it has now surprisingly been found that modulating expression in a plant of a nucleic acid encoding a CLC-pKG polypeptide gives plants having enhanced yield-related traits relative to control plants. According to a first embodiment, the present invention provides a method for enhancing yield-related traits in plants relative to control plants, comprising modulating expression in a plant of a nucleic acid encoding a CLC-pKG polypeptide and optionally selecting for plants having enhanced yield-related traits.

Furthermore, it has now surprisingly been found that modulating expression in a plant of a nucleic acid encoding a HD-hydrolase-like polypeptide gives plants having enhanced yield-related traits relative to control plants. According to a first embodiment, the present invention provides a method for enhancing yield-related traits in plants relative to control plants, comprising modulating expression in a plant of a nucleic acid encoding a HD-hydrolase-like polypeptide and optionally selecting for plants having enhanced yield-related traits.

A preferred method for modulating (preferably, increasing) expression of a nucleic acid encoding an SGT1 polypeptide, or a CLC-pKG polypeptide, or a HD-hydrolase-like polypeptide, is by introducing and expressing in a plant a nucleic acid encoding an SGT1 polypeptide, or a CLC-pKG polypeptide, or a HD-hydrolase-like polypeptide respectively.

In one embodiment a "protein useful in the methods of the invention" is taken to mean an SGT1 polypeptide as defined herein. Any reference hereinafter to a "nucleic acid useful in the methods of the invention" is taken to mean a nucleic acid capable of encoding such an SGT1 polypeptide. The nucleic acid to be introduced into a plant (and therefore useful in performing the methods of the invention) is any nucleic acid encoding the type of protein which will now be described, hereinafter also named "SGT1 nucleic acid" or "SGT1 gene".

An "SGT1 polypeptide" as defined herein refers to any polypeptide comprising the following in any order:
1. at least one tetratricopeptide (TPR) repeat;
2. at least one CS domain; and
3. an SGS domain.

The TPR is a structural motif involved in the mediation of protein-protein interactions and the assembly of multiprotein complexes. PFam Accession number PF00515 represents TPRs. See also Interpro Accession number IPRO01440 for further information on TPRs. SGT1 polypeptides useful in the methods of the invention comprise at least one TPR, preferably two TPRs and most preferably three TPRs.

The first TPR is a Type 1 TPR (TPR1) and is represented by the sequence given below or by a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of TPR1.

```
                                        (SEQ ID NO: 37)
TPR1:    SKAYLRKGLACMKLEEYQTAKAALETGASLAPGE
```

The second TPR is a Type 2 TPR (TPR2) and is represented by the sequence given below or by a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of TPR2a.

```
                                        (SEQ ID NO: 38)
TPR2a:   ASDLETRAKEAFIDDHFELAVDLYTQAISLSPKN
```

The third TPR is also a Type 2 TPR (TPR2) is represented by the sequence given below or by a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of TPR2b.

```
                                        (SEQ ID NO: 39)
TPR2b:   PELFADRAQANIKLNYFTEAVVDANKAIELDPYM
```

PFam Accession number PF04969 represents CS domains. See also Interpro Accession number IPRO17447 for further information on CS domains. The CS domain is represented by the sequence below or by a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence below.

```
CS Domain:
                                        (SEQ ID NO: 40)
YRHEFYQKPEEVVVTIFAKGIPAKNVVVDFGEQILSVSIDLPGGETYSFQ

PRLFGKITPAKCRYEVMSTKIEIRLAK
```

PFam Accession number PF05002 represents SGS domains. See also Interpro Accession number IPRO07699 for further information on SGS domains. The SGS domain is represented by the sequence below or by a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence below.

```
SGS Domain:
                                        (SEQ ID NO: 41)
NVDWDKLEAQVKKEEKDEKLDGDAALNKFFRDIYKDADEDTRRAMMKSF

VESNGTVLSTNWKKVGTKKVEGSPPDGMELKKW
```

According to a preferred feature of the present invention, SGT1 polypeptides useful in the methods of the invention may comprise any one or more of Motifs 1 to 8 as defined below:

Motif 1: DLETRAKEAFIDDHFELAVDLYTQAI, or a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of Motif 1 (SEQ ID NO: 42).

Motif 2: ADRAQANIKL, or a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of Motif 2 (SEQ ID NO: 43).

Motif 3: LEEYQTAKAALETGAS, or a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of Motif 3 (SEQ ID NO: 44).

Motif 4: KYRHEFYQKPEEVVVTIFAKGIP, or a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of Motif 4 (SEQ ID NO: 45).

Motif 5: QPRLFGKITPAKCRYEVMSTKIEIRLAKAE, or a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of Motif 5 (SEQ ID NO: 46).

Motif 6: EAQVKKEEKDEKLDGDA, or a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of Motif 6 (SEQ ID NO: 47).

Motif 7: ALNKFFRDIYKDADEDTRRAMMKSFVESNGTVLSTNWKKVGTKKVEG, or a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of Motif 7 (SEQ ID NO: 48).

Motif 8: SPPDGMELKKWEI, or a sequence having in increasing order of preference at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% or more sequence identity to the sequence of Motif 8 (SEQ ID NO: 49).

Preferably, the SGT1 polypeptide comprises in increasing order of preference, at least 2, at least 3, at least 4, at least 5, at least 6, at least 7 or all 8 of the motifs as defined above.

Additionally, SGT1 polypeptides typically have in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 2.

The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Preferably, the polypeptide sequence which when used in the construction of a phylogenetic tree, such as the one depicted in FIG. 2, clusters with the group of SGT1 polypeptides comprising the amino acid sequence represented by SEQ ID NO: 2 rather than with any other group.

In another embodiment a "protein useful in the methods of the invention" is taken to mean a CLC-pKG polypeptide as defined herein. Any reference hereinafter to a "nucleic acid useful in the methods of the invention" is taken to mean a nucleic acid capable of encoding such a CLC-pKG polypeptide. The nucleic acid to be introduced into a plant (and therefore useful in performing the methods of the invention) is any nucleic acid encoding the type of protein which will now be described, hereafter also named "CLC-pKG nucleic acid" or "CLC-pKG gene".

A "CLC-pKG polypeptide" as defined herein refers to any polypeptide comprising a Voltage CLC domain (Pfam entry PF00654) and C-terminally thereof a CBS domain (Pfam entry PF00571; Interpro entry IPRO00644) and optionally a USP domain (Pfam entry PF00582; Interpro entry IPRO06016). CLC-pKG polypeptides are part of a family of voltage-gated channels that is highly conserved over various kingdoms of life and are structurally unrelated to the other known voltage-gated channels. They are found in organisms ranging from bacteria to yeasts and plants, and also in animals. CLC-pKG polypeptides typically have 10 or 12 transmembrane (TM) domains, occasionally less than 10 TM domains or more than 12, up to 18 or 20 TM domains may occur. The CLC-pKG polypeptide represented by the Arabidopsis AtCLCe and AtCLCf proteins show up to 12 membrane-spanning domains Marmagne et al. 2007. CBS (cystathionine-beta-synthase) domains are small intracellular modules, mostly found in two or four copies within a protein (two copies for CLC-pKG proteins), and are present in several different proteins in all kingdoms of life. Tandem pairs of CBS domains, also called Baeteman domains, can act as binding domains for adenosine derivatives and may regulate the activity of attached enzymatic or other domains. Typically CBS domains in CLC-pKG polypeptides are proposed to play a role as a sensor for the energy status of the cell. USP (Universal Stress Protein) domains are conserved protein regions present in proteins whose expression in nature is typically enhanced when the cell is exposed to stress agents. It was first characterized in the universal stress protein UspA (Nystrom T, Neidhardt FC. Mol. Microbiol. 11 537-44 1994), which is proposed to have a a general "stress endurance" activity in E. coli.

Preferably, the CLC-pKG polypeptide useful in the methods of the present inventions comprises a domain having in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to:
(i) a CLC in SEQ ID NO: 54 as represented by the sequence located between amino acids 77 and 422 of SEQ ID NO: 54;
(ii) a CBS domain in SEQ ID NO: 54 as represented by the sequence located between amino acids 455 to 510 or 516 to 571 of SEQ ID NO: 54; and optionally
(iii) a USP domain in SEQ ID NO: 54 as represented by the sequence located between amino acids 597-731 of SEQ ID NO: 54.

Preferably, the CLC-pKG polypeptide useful in the methods of the present inventions comprises one or more of motifs 9 or 10:
Motif 9: P(T/S)(V/I)(H/Q)(I/V)GA(A/S/G)LA (SEQ ID NO: 113);
Motif 10: (P/S)GG(I/L/V)(F/L)XP(A/S/T)LX(L/M)G(S/A/T)XLG (SEQ ID NO: 114);
Wherein up to one, two, three, four, five, six, seven amino acids may be substituted by any amino acid preferably by a semiconservative amino acid more preferably by a conservative amino acid.

Additionally or alternatively, the CLC-pKG polypeptide useful in the methods of the invention or a homologue thereof has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% overall sequence identity to the amino acid represented by any one of the polypeptides of Table A2, preferably by SEQ ID NO: 54, provided that the polypeptide comprises the conserved domains as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

In a preferred embodiment the CLC-pKG nucleic acid and/or polypeptide useful in the methods of the invention is of natural origin, more of plant origin, most preferably of prokaryotic origin. Preferred plant CLC-pKG polypeptides are AtClC-e (At4g35440) and AtClC-f (At1g55620) as described by Marmagne et al 2007 and having the locus number or Spinach CLCf as described by Teardo et al. 2005 FEBS Letters 579 (2005) 4991-4996. As described by Teardo et al. 2005, AtClC-f and AtClC-e are close related in sequence structure to cyanobacterial ClC channels (See Table 1 of Teardo et al. 2005). in particular the similarity with the *Synechocystis* sp. PCC 6803 protein, sll1864, the sequence similarity is of 20% with AtClC-e and of 21% with AtClC-f. Preferred prokaryotic CLC-pKG polypeptides are the polypeptides of *Synechocystis* species, more preferably of *Synechocystis* sp. PCC 6803, most preferably polypeptide sll1864 of *Synechocystis* sp. PCC 6803, herein provided under SEQ ID NO: 54.

Alternatively or additonaly, the CLC-pKG polypeptide sequence useful in the methods of the invention when used in the construction of a phylogenetic tree, such as the one depicted in FIG. 1 of Marmagne et al. 2007 (herein incorporated by reference), clusters with the group of CLC polypeptides of bacterial origin, preferably with SCLC (P74477) from *Synechocystis* sp.; or with the group of plant origin comprising AtCLCe and AtCLCf than with any other anion group. FIG. 1 of Marmagne et al. 2007 is given in FIG. 6 herein.

Furthermore, CLC-like polypeptides (at least in their native form) typically have nitrate/H⁺ exchanging activity. Tools and techniques for measuring anion transporting activity are well known in the art, for example by complementation of yeast mutants (Marmagne et al., J. Exp. Bot. 58, 3385-3393, 2007) or complementation of *Arabidopsis* mutants (De Angeli, 2009). Further details are provided in the Example section.

Selectivity of CLC chloride channels for different anions vary amongst classes of CLC proteins. Thus AtCLCa of *Arabidopsis thaliana*, closer to CLC proteins of eukaryotic origin (see FIG. 6) was shown to have a higher selectivity for NO3—anions than for Chloride, Cl—. A further preferred CLC-pKG polypeptide useful in the methods of the invention has a higher selectivity for Chloride than for Nitrate anions.

Plant CLC polypeptides are localized to membranes, with different classes of CLC localized to different membranes, for example to the plasma, the tonoplast, the chloroplast or the golgi membranes. A yet further preferred CLC-pKG polypeptide useful in the methods of the invention localizes to the Golgi or to the Thylakoid membranes when expressed in a plant cell.

In addition or alternatively, CLC-pKG polypeptides, when expressed in rice according to the methods of the present invention as outlined in the Examples section herein give plants having increased yield related traits in comparison to control plants, in particular an increase in any one or more of seed yield, harvest index, height of the plant, leaf biomass when grown under non-stress conditions.

In yet another embodiment a "protein useful in the methods of the invention" is taken to mean a HD-hydrolase-like polypeptide as defined herein. Any reference hereinafter to a "nucleic acid useful in the methods of the invention" is taken to mean a nucleic acid capable of encoding such a HD-hydrolase-like polypeptide. The nucleic acid to be introduced into a plant (and therefore useful in performing the methods of the invention) is any nucleic acid encoding the type of protein which will now be described, hereafter also named "HD-hydrolase-like nucleic acid" or "HD-hydrolase-like gene".

A "HD-hydrolase-like polypeptide" as defined herein refers to a protein comprising the CRISPR-associated protein Crm2 domain (InterPro accession IPR013407). Preferably the HD-hydrolase-like protein comprises one or more of the following motifs:

Motif 11 (SEQ ID NO: 148): (A/G/S/Q)(R/Y/F/L)(L/F/N)H(D/S)(P/S)(A/P/L)
Preferably, motif 11 is (G/A)LLHDPA
Motif 12 (SEQ ID NO: 149): P(A/Q)(D/E/H)(T/Y/S)(R/I)(I/F/A/L)P(D/N)
Preferably, motif 12 is PA(D/E)TR(I/F/A/L)P(D/N)
Motif 13 (SEQ ID NO: 150): (T/S)(L/I/F)(G/S/N)P(V/I)Q(E/S/Q/D/R)(L/F/Y)I
Preferably, motif 13 is (T/S)(L/I/F)(G/S)P(V/I)Q(E/S)(L/F/Y)I
Motif 14 (SEQ ID NO: 151): D(L/F)(W/Y/F)(A/W/M/T)(G/S)S(H/Y/W/F/M)(L/I/M)L(A/S/H)(R/Y/D)(L/F).
Preferably, motif 14 is D(L/F)(W/Y/F)(A/W/M/T)GS(H/Y/W)(L/I/M)L(A/S/H)(R/Y)(L/F)
Motif 15 (SEQ ID NO: 152): (L/I/V)(F/Y/T)PXL
Wherein X can be any amino acid but preferably one of Q, R, E, N, S, C or D
Motif 16 (SEQ ID NO: 153): (L/M/F/I)PN(R/V/T)(F/I/L)
Motif 17 (SEQ ID NO: 154): (M/L/G/F)DGDX(M/I)
Wherein X can be any amino acid but preferably one of R, Y, N, H, G, S or D
Preferably, motif 7 is GDGD(G/S/D)M
Motif 18 SEQ ID NO: 155): (S/T/G/A)P(A/G/S/T)(R/V/L/T/I)H(L/S/Q/N/V/A)(A/L/T/G/F) (I/L/V) (S/N) (G/E/R/L)
Motif 19 (SEQ ID NO: 156): G(R/K)(V/L)(L/I/V)Y(A/S)GGDD(L/V)(M/F/L)(A/T)
Motif 20 (SEQ ID NO: 157): (T/S)(A/M/I/L)S(M/A/F/C/L)G(A/V/I/L)(V/T/A)I(A/V/G)(H/D) (H/Y/K)(K/Q/S)

Additionally or alternatively, the HD-hydrolase-like polypeptide comprises one or more of the following motifs:
Motif 21 (SEQ ID NO: 158): IKASRK(F/I/M)(L/R/K)DFWAGS(Y/W)(L/I)LHYLSA
Motif 22 (SEQ ID NO: 159): L(A/L)TAGFPN
Motif 23 (SEQ ID NO: 160): GLFDG(S/T/R/I)E(M/K/Q)LNA(L/T)E(L/I/T)(T/V/L)KR
Motif 24 (SEQ ID NO: 161): KRMGP(A/S)TH(V/S/N)(G/A)L(N/S)RALLDFS
Motif 25 (SEQ ID NO: 162): Y(S/A)GGDDV
Motif 26 (SEQ ID NO: 163): LFT(M/L)G(F/K/S/Q/D)(G/C/L/A/N)A(T/S)(M/I)S(L/F)G (I/V/L)(V/T)I(V/A)(D/H)(K/H)S(V/I)PL(P/A)(V/I)ALE(A/S/N)LW(E/Q)AE More preferably, the HD-hydrolase-like polypeptide comprises in increasing order of preference, at least 2, at least 3, at least 4, at least 5, at least 6, at least 7, at least 8, at least 9, at least 10, at least 11, at least 12, at least 13, at least 14, at least 15, or all 16 motifs.

Additionally or alternatively, the homologue of a HD-hydrolase-like protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 119, provided that the homologous protein comprises any one or more of the conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered. Preferably the motifs in a HD-hydrolase-like polypeptide have, in increasing order of preference, at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one or more of the motifs represented by SEQ ID NO: 148 to SEQ ID NO: 163 (Motifs 11 to 26).

Preferably, the polypeptide sequence which when used in the construction of a phylogenetic tree, such as the one depicted in FIG. 10, clusters with the group of HD-hydrolase-like polypeptides comprising the amino acid sequence represented by SEQ ID NO: 119 rather than with any other group.

HD-hydrolase-like polypeptides, when expressed in rice according to the methods of the present invention as outlined in Examples 6 and 7, give plants having increased yield related traits, such as increased seed yield.

The terms "domain", "signature" and "motif" are defined in the "definitions" section herein.

Concerning SGT1 polypeptides, the present invention is illustrated by transforming plants with the nucleic acid sequence represented by SEQ ID NO: 1, encoding the polypeptide sequence of SEQ ID NO: 2. However, performance of the invention is not restricted to these sequences; the methods of the invention may advantageously be performed using any SGT1-encoding nucleic acid or SGT1 polypeptide as defined herein.

Examples of nucleic acids encoding SGT1 polypeptides are given in Table A1 of the Examples section herein. Such nucleic acids are useful in performing the methods of the invention. The amino acid sequences given in Table A1 of the Examples section are example sequences of orthologues and paralogues of the SGT1 polypeptide represented by SEQ ID NO: 2, the terms "orthologues" and "paralogues" being as defined herein. Further orthologues and paralogues may readily be identified by performing a so-called reciprocal blast search as described in the definitions section; where the query sequence is SEQ ID NO: 1 or SEQ ID NO: 2, the second BLAST (back-BLAST) would be against *Capsicum* sequences.

Concerning CLC-pKG polypeptides, the present invention is illustrated by transforming plants with the nucleic acid sequence represented by SEQ ID NO: 53, encoding the polypeptide sequence of SEQ ID NO: 54. However, performance of the invention is not restricted to these sequences; the methods of the invention may advantageously be performed using any CLC-pKG-encoding nucleic acid or CLC-pKG polypeptide as defined herein.

Examples of nucleic acids encoding CLC-pKG polypeptides are given in Table A2 of the Examples section herein. Such nucleic acids are useful in performing the methods of the invention. The amino acid sequences given in Table A2 of the Examples section are example sequences of orthologues and paralogues of the CLC-pKG polypeptide represented by SEQ ID NO: 54, the terms "orthologues" and "paralogues" being as defined herein. Further orthologues and paralogues may readily be identified by performing a so-called reciprocal blast search as described in the definitions section; where the query sequence is SEQ ID NO: 53 or SEQ ID NO: 54, the second BLAST (back-BLAST) would be against rice sequences.

Concerning HD-hydrolase-like polypeptides, the present invention is illustrated by transforming plants with the nucleic acid sequence represented by SEQ ID NO: 118, encoding the polypeptide sequence of SEQ ID NO: 119. However, performance of the invention is not restricted to these sequences; the methods of the invention may advantageously be performed using any HD-hydrolase-like-encoding nucleic acid or HD-hydrolase-like polypeptide as defined herein.

Examples of nucleic acids encoding HD-hydrolase-like polypeptides are given in Table A3 of the Examples section herein. Such nucleic acids are useful in performing the methods of the invention. The amino acid sequences given in Table A3 of the Examples section are example sequences of orthologues and paralogues of the HD-hydrolase-like polypeptide represented by SEQ ID NO: 119, the terms "orthologues" and "paralogues" being as defined herein. Further orthologues and paralogues may readily be identified by performing a so-called reciprocal blast search as described in the definitions section; where the query sequence is SEQ ID NO: 118 or SEQ ID NO: 119, the second BLAST (back-BLAST) would be against *Synechocystis* sequences.

Nucleic acid variants may also be useful in practising the methods of the invention. Examples of such variants include nucleic acids encoding homologues and derivatives of any one of the amino acid sequences given in Table A1 to A3 of the Examples section, the terms "homologue" and "derivative" being as defined herein. Also useful in the methods of the invention are nucleic acids encoding homologues and derivatives of orthologues or paralogues of any one of the amino acid sequences given in Table A1 to A3 of the Examples section. Homologues and derivatives useful in the methods of the present invention have substantially the same biological and functional activity as the unmodified protein from which they are derived. Further variants useful in practising the methods of the invention are variants in which codon usage is optimised or in which miRNA target sites are removed.

Further nucleic acid variants useful in practising the methods of the invention include portions of nucleic acids encoding SGT1 polypeptides, or CLC-pKG polypeptides, or HD-hydrolase-like polypeptides, nucleic acids hybridising to nucleic acids encoding SGT1 polypeptides, or CLC-pKG polypeptides, or HD-hydrolase-like polypeptides, splice variants of nucleic acids encoding SGT1 polypeptides, or CLC-pKG polypeptides, or HD-hydrolase-like polypeptides, allelic variants of nucleic acids encoding SGT1 polypeptides and variants of nucleic acids encoding SGT1 polypeptides, or CLC-pKG polypeptides, or HD-hydrolase-like polypeptides, obtained by gene shuffling. The terms hybridising sequence, splice variant, allelic variant and gene shuffling are as described herein.

Nucleic acids encoding SGT1 polypeptides, or CLC-pKG polypeptides, or HD-hydrolase-like polypeptides, need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A1 to A3 of the Examples section, or a portion of a nucleic acid encoding an orthologue, paralogue or homologue of any of the amino acid sequences given in Table A1 to A3 of the Examples section.

A portion of a nucleic acid may be prepared, for example, by making one or more deletions to the nucleic acid. The portions may be used in isolated form or they may be fused to other coding (or non-coding) sequences in order to, for example, produce a protein that combines several activities.

When fused to other coding sequences, the resultant polypeptide produced upon translation may be bigger than that predicted for the protein portion.

Concerning SGT1 polypeptides, portions useful in the methods of the invention, encode a SGT1 polypeptide as defined herein, and have substantially the same biological activity as the amino acid sequences given in Table A1 of the Examples section. Preferably, the portion is a portion of any one of the nucleic acids given in Table A1 of the Examples section, or is a portion of a nucleic acid encoding an orthologue or paralogue of any one of the amino acid sequences given in Table A1 of the Examples section. Preferably the portion is at least 500, 550, 600, 650, 700, 750, 800, 850, 900, 950, 1000 consecutive nucleotides in length, the consecutive nucleotides being of any one of the nucleic acid sequences given in Table A1 of the Examples section, or of a nucleic acid encoding an orthologue or paralogue of any one of the amino acid sequences given in Table A1 of the Examples section. Most preferably the portion is a portion of the nucleic acid of SEQ ID NO: 1. Preferably, the portion encodes a fragment of an amino acid sequence which, when used in the construction of a phylogenetic tree, clusters with the group of SGT1 polypeptides comprising the amino acid sequence represented by SEQ ID NO: 2 rather than with any other.

Concerning CLC-pKG polypeptides, portions useful in the methods of the invention, encode a CLC-pKG polypeptide as defined herein, and have substantially the same biological activity as the amino acid sequences given in Table A2 of the Examples section. Preferably, the portion is a portion of any one of the nucleic acids given in Table A2 of the Examples section, or is a portion of a nucleic acid encoding an orthologue or paralogue of any one of the amino acid sequences given in Table A2 of the Examples section. Preferably the portion is at least 100, 200, 300, 400, 500, 550, 600, 650, 700, 750, 800, 850, 900, 950, 1000 consecutive nucleotides in length, the consecutive nucleotides being of any one of the nucleic acid sequences given in Table A2 of the Examples section, or of a nucleic acid encoding an orthologue or paralogue of any one of the amino acid sequences given in Table A2 of the Examples section. Most preferably the portion is a portion of the nucleic acid of SEQ ID NO: 53. Preferably, the portion encodes a fragment of an amino acid sequence which, when used in the construction of a phylogenetic tree, such as the one depicted in FIG. 1 of Marmagne et al. 2007 (herein incorporated by reference), clusters with the group of CLC polypeptides of bacterial origin, preferably with SCLC (P74477) from *Synechocystis* sp.; or with the group of plant origin comprising AtCLCe and AtCLCf than with any other anion group.

Concerning HD-hydrolase-like polypeptides, portions useful in the methods of the invention, encode a HD-hydrolase-like polypeptide as defined herein, and have substantially the same biological activity as the amino acid sequences given in Table A3 of the Examples section. Preferably, the portion is a portion of any one of the nucleic acids given in Table A3 of the Examples section, or is a portion of a nucleic acid encoding an orthologue or paralogue of any one of the amino acid sequences given in Table A3 of the Examples section. Preferably the portion is at least 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700 consecutive nucleotides in length, the consecutive nucleotides being of any one of the nucleic acid sequences given in Table A3 of the Examples section, or of a nucleic acid encoding an orthologue or paralogue of any one of the amino acid sequences given in Table A3 of the Examples section. Most preferably the portion is a portion of the nucleic acid of SEQ ID NO: 118. Preferably, the portion encodes a fragment of an amino acid sequence which, when used in the construction of a phylogenetic tree, such as the one depicted in FIG. 10, clusters with the group of HD-hydrolase-like polypeptides comprising the amino acid sequence represented by SEQ ID NO: 119 rather than with any other group and/or comprises any one or more of the motifs 11 to 26 defined above.

Another nucleic acid variant useful in the methods of the invention is a nucleic acid capable of hybridising, under reduced stringency conditions, preferably under stringent conditions, with a nucleic acid encoding an SGT1 polypeptide, or a CLC-pKG polypeptide, or a HD-hydrolase-like polypeptide, as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table A1 to A3 of the Examples section, or comprising introducing and expressing in a plant a nucleic acid capable of hybridising to a nucleic acid encoding an orthologue, paralogue or homologue of any of the nucleic acid sequences given in Table A1 to A3 of the Examples section.

Concerning SGT1 polypeptides, hybridising sequences useful in the methods of the invention encode an SGT1 polypeptide as defined herein, having substantially the same biological activity as the amino acid sequences given in Table A1 of the Examples section. Preferably, the hybridising sequence is capable of hybridising to the complement of any one of the nucleic acids given in Table A1 of the Examples section, or to a portion of any of these sequences, a portion being as defined above, or the hybridising sequence is capable of hybridising to the complement of a nucleic acid encoding an orthologue or paralogue of any one of the amino acid sequences given in Table A1 of the Examples section. Most preferably, the hybridising sequence is capable of hybridising to the complement of a nucleic acid as represented by SEQ ID NO: 1 or to a portion thereof.

Preferably, the hybridising sequence encodes a polypeptide with an amino acid sequence which, when substantially full-length and used in the construction of a phylogenetic tree, clusters with the group of SGT1 polypeptides comprising the amino acid sequence represented by SEQ ID NO: 2 rather than with any other.

Concerning CLC-pKG polypeptides, hybridising sequences useful in the methods of the invention encode a CLC-pKG polypeptide as defined herein, having substantially the same biological activity as the amino acid sequences given in Table A2 of the Examples section. Preferably, the hybridising sequence is capable of hybridising to the complement of any one of the nucleic acids given in Table A2 of the Examples section, or to a portion of any of these sequences, a portion being as defined above, or the hybridising sequence is capable of hybridising to the complement of a nucleic acid encoding an orthologue or paralogue of any one of the amino acid sequences given in Table A2 of the Examples section. Most preferably, the hybridising sequence is capable of hybridising to the complement of a nucleic acid as represented by SEQ ID NO: 53 or to a portion thereof.

Preferably, the hybridising sequence encodes a polypeptide with an amino acid sequence which, when full-length and used in the construction of a phylogenetic tree, such as the one depicted in FIG. 1 of Marmagne et al. 2007 (herein incorporated by reference), clusters with the group of CLC polypeptides of bacterial origin, preferably with SCLC (P74477)

from *Synechocystis* sp.; or with the group of plant origin comprising AtCLCe and AtCLCf than with any other anion group.

Concerning HD-hydrolase-like polypeptides, hybridising sequences useful in the methods of the invention encode a HD-hydrolase-like polypeptide as defined herein, having substantially the same biological activity as the amino acid sequences given in Table A3 of the Examples section. Preferably, the hybridising sequence is capable of hybridising to the complement of any one of the nucleic acids given in Table A3 of the Examples section, or to a portion of any of these sequences, a portion being as defined above, or the hybridising sequence is capable of hybridising to the complement of a nucleic acid encoding an orthologue or paralogue of any one of the amino acid sequences given in Table A3 of the Examples section. Most preferably, the hybridising sequence is capable of hybridising to the complement of a nucleic acid as represented by SEQ ID NO: 118 or to a portion thereof.

Preferably, the hybridising sequence encodes a polypeptide with an amino acid sequence which, when full-length and used in the construction of a phylogenetic tree, such as the one depicted in FIG. 10, clusters with the group of HD-hydrolase-like polypeptides comprising the amino acid sequence represented by SEQ ID NO: 119 rather than with any other group and/or comprises any one or more of the motifs 11 to 26 defined above.

Another nucleic acid variant useful in the methods of the invention is a splice variant encoding an SGT1 polypeptide, or a CLC-pKG polypeptide, or a HD-hydrolase-like polypeptide, as defined hereinabove, a splice variant being as defined herein.

According to the present invention, there is provided a method for enhancing yield-related traits in plants, comprising introducing and expressing in a plant a splice variant of any one of the nucleic acid sequences given in Table A1 to A3 of the Examples section, or a splice variant of a nucleic acid encoding an orthologue, paralogue or homologue of any of the amino acid sequences given in Table A1 to A3 of the Examples section.

Concerning SGT1 polypeptides, preferred splice variants are splice variants of a nucleic acid represented by SEQ ID NO: 1, or a splice variant of a nucleic acid encoding an orthologue or paralogue of SEQ ID NO: 2. Preferably, the amino acid sequence encoded by the splice variant, when used in the construction of a phylogenetic tree, clusters with the group of SGT1 polypeptides comprising the amino acid sequence represented by SEQ ID NO: 2 rather than with any other group.

Concerning CLC-pKG polypeptides, preferred splice variants are splice variants of a nucleic acid represented by SEQ ID NO: 53, or a splice variant of a nucleic acid encoding an orthologue or paralogue of SEQ ID NO: 54. Preferably, the amino acid sequence encoded by the splice variant, when used in the construction of a phylogenetic tree, such as the one depicted in FIG. 1 of Marmagne et al. 2007 (herein incorporated by reference), clusters with the group of CLC polypeptides of bacterial origin, preferably with SCLC (P74477) from *Synechocystis* sp.; or with the group of plant origin comprising AtCLCe and AtCLCf than with any other anion group.

Concerning HD-hydrolase-like polypeptides, preferred splice variants are splice variants of a nucleic acid represented by SEQ ID NO: 118, or a splice variant of a nucleic acid encoding an orthologue or paralogue of SEQ ID NO: 119. Preferably, the amino acid sequence encoded by the splice variant, when used in the construction of a phylogenetic tree, such as the one depicted in FIG. 10, clusters with the group of HD-hydrolase-like polypeptides comprising the amino acid sequence represented by SEQ ID NO: 119 rather than with any other group and/or comprises any one or more of the motifs 11 to 26 defined above.

Another nucleic acid variant useful in performing the methods of the invention is an allelic variant of a nucleic acid encoding an SGT1 polypeptide, or a CLC-pKG polypeptide, or a HD-hydrolase-like polypeptide, as defined hereinabove, an allelic variant being as defined herein.

According to the present invention, there is provided a method for enhancing yield-related traits in plants, comprising introducing and expressing in a plant an allelic variant of any one of the nucleic acids given in Table A1 to A3 of the Examples section, or comprising introducing and expressing in a plant an allelic variant of a nucleic acid encoding an orthologue, paralogue or homologue of any of the amino acid sequences given in Table A1 to A3 of the Examples section.

Concerning SGT1 polypeptides, the polypeptides encoded by allelic variants useful in the methods of the present invention have substantially the same biological activity as the SGT1 polypeptide of SEQ ID NO: 2 and any of the amino acids depicted in Table A1 of the Examples section. Allelic variants exist in nature, and encompassed within the methods of the present invention is the use of these natural alleles. Preferably, the allelic variant is an allelic variant of SEQ ID NO: 1 or an allelic variant of a nucleic acid encoding an orthologue or paralogue of SEQ ID NO: 2. Preferably, the amino acid sequence encoded by the allelic variant, when used in the construction of a phylogenetic tree, clusters with the SGT1 polypeptides comprising the amino acid sequence represented by SEQ ID NO: 2 rather than with any other group.

Concerning CLC-pKG polypeptides, the polypeptides encoded by allelic variants useful in the methods of the present invention have substantially the same biological activity as the CLC-pKG polypeptide of SEQ ID NO: 54 and any of the amino acids depicted in Table A2 of the Examples section. Allelic variants exist in nature, and encompassed within the methods of the present invention is the use of these natural alleles. Preferably, the allelic variant is an allelic variant of SEQ ID NO: 53 or an allelic variant of a nucleic acid encoding an orthologue or paralogue of SEQ ID NO: 54. Preferably, the amino acid sequence encoded by the allelic variant, when used in the construction of a phylogenetic tree, such as the one depicted in FIG. 1 of Marmagne et al. 2007 (herein incorporated by reference), clusters with the group of CLC polypeptides of bacterial origin, preferably with SCLC (P74477) from *Synechocystis* sp.; or with the group of plant origin comprising AtCLCe and AtCLCf than with any other anion group.

Concerning HD-hydrolase-like polypeptides, the polypeptides encoded by allelic variants useful in the methods of the present invention have substantially the same biological activity as the HD-hydrolase-like polypeptide of SEQ ID NO: 119 and any of the amino acids depicted in Table A3 of the Examples section. Allelic variants exist in nature, and encompassed within the methods of the present invention is the use of these natural alleles. Preferably, the allelic variant is an allelic variant of SEQ ID NO: 118 or an allelic variant of a nucleic acid encoding an orthologue or paralogue of SEQ ID NO: 119. Preferably, the amino acid sequence encoded by the allelic variant, when used in the construction of a phylogenetic tree, such as the one depicted in FIG. 10, clusters with the group of HD-hydrolase-like polypeptides comprising the amino acid sequence represented by SEQ ID NO: 119 rather than with any other group and/or comprises any one or more of the motifs 11 to 26 defined above.

Gene shuffling or directed evolution may also be used to generate variants of nucleic acids encoding SGT1 polypeptides, or CLC-pKG polypeptides, or HD-hydrolase-like polypeptides, as defined above; the term "gene shuffling" being as defined herein.

According to the present invention, there is provided a method for enhancing yield-related traits in plants, comprising introducing and expressing in a plant a variant of any one of the nucleic acid sequences given in Table A1 to A3 of the Examples section, or comprising introducing and expressing in a plant a variant of a nucleic acid encoding an orthologue, paralogue or homologue of any of the amino acid sequences given in Table A1 to A3 of the Examples section, which variant nucleic acid is obtained by gene shuffling.

Concerning SGT1 polypeptides, preferably, the amino acid sequence encoded by the variant nucleic acid obtained by gene shuffling, when used in the construction of a phylogenetic tree, clusters with the group of SGT1 polypeptides comprising the amino acid sequence represented by SEQ ID NO: 2 rather than with any other group.

Concerning CLC-pKG polypeptides, preferably, the amino acid sequence encoded by the variant nucleic acid obtained by gene shuffling, when used in the construction of a phylogenetic tree such as the one depicted in FIG. 1 of Marmagne et al. 2007 (herein incorporated by reference), clusters with the group of CLC polypeptides of bacterial origin, preferably with SCLC (P74477) from *Synechocystis* sp.; or with the group of plant origin comprising AtCLCe and AtCLCf than with any other anion group.

Concerning HD-hydrolase-like polypeptides, preferably, the amino acid sequence encoded by the variant nucleic acid obtained by gene shuffling, when used in the construction of a phylogenetic tree, such as the one depicted in FIG. 10, clusters with the group of HD-hydrolase-like polypeptides comprising the amino acid sequence represented by SEQ ID NO: 119 rather than with any other group and/or comprises any one or more of the motifs 11 to 26 defined above.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding SGT1 polypeptides may be derived from any natural or artificial source. The nucleic acid may be modified from its native form in composition and/or genomic environment through deliberate human manipulation. Preferably the SGT1 polypeptide-encoding nucleic acid is from a plant, further preferably from pepper, most preferably the nucleic acid is from *Capsicum annuum*.

Nucleic acids encoding CLC-pKG polypeptides may be derived from any natural or artificial source. The nucleic acid may be modified from its native form in composition and/or genomic environment through deliberate human manipulation. Preferably the CLC-pKG polypeptide-encoding nucleic acid is from a cyanobacterial origin, further preferably from *Synechocystis* species, most preferably from *Synechocystis* sp. PCC 6803.

Nucleic acids encoding HD-hydrolase-like polypeptides may be derived from any natural or artificial source. The nucleic acid may be modified from its native form in composition and/or genomic environment through deliberate human manipulation. Preferably the HD-hydrolase-like polypeptide-encoding nucleic acid is from a plant or a bacterium, further preferably from a cyanophyte, more preferably from the family Chroococcaceae, most preferably the nucleic acid is from *Synechocystis* sp.

Performance of the methods of the invention gives plants having enhanced yield-related traits. In particular, performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase early vigour and/or in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants.

The present invention provides a method for increasing yield-related traits, especially seed yield in plants, relative to control plants, which method comprises modulating expression in a plant of a nucleic acid encoding an SGT1 polypeptide, or a CLC-pKG polypeptide, or a HD-hydrolase-like polypeptide, as defined herein.

Since the transgenic plants according to the present invention have increased yield and/or increased yield-related traits, it is likely that these plants exhibit an increased growth rate (during at least part of their life cycle), relative to the growth rate of control plants at a corresponding stage in their life cycle.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding an SGT1 polypeptide, or a CLC-pKG polypeptide, or a HD-hydrolase-like polypeptide, as defined herein.

Performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding an SGT1 polypeptide, or a CLC-pKG polypeptide, or a HD-hydrolase-like polypeptide.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding an SGT1 polypeptide, or a CLC-pKG polypeptide, or a HD-hydrolase-like polypeptide.

Performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises modulating expression in a plant of a nucleic acid encoding an SGT1 polypeptide, or a CLC-pKG polypeptide, or a HD-hydrolase-like polypeptide.

The invention also provides genetic constructs and vectors to facilitate introduction and/or expression in plants of nucleic acids encoding an SGT1 polypeptide, or a CLC-pKG polypeptide, or a HD-hydrolase-like polypeptide. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding an SGT1 polypeptide, or a CLC-pKG polypeptide, or a HD-hydrolase-like polypeptide, as defined above;
(b) one or more control sequences capable of driving expression of the nucleic acid sequence of (a); and optionally
(c) a transcription termination sequence.

Preferably, the nucleic acid encoding an SGT1 polypeptide, or a CLC-pKG polypeptide, or a HD-hydrolase-like polypeptide, is as defined above. The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Concerning SGT1 polypeptides, advantageously, any type of promoter, whether natural or synthetic, may be used to drive expression of the nucleic acid sequence, but preferably the promoter is of plant origin. A root-specific promoter is particularly useful in the methods. The root-specific promoter is preferably an RCc3 promoter (Plant Mol Biol. 1995 January; 27(2):237-48), more preferably the RCc3 promoter is from rice, further preferably the RCc3 promoter is represented by a nucleic acid sequence substantially similar to SEQ ID NO: 50, most preferably the promoter is as represented by SEQ ID NO: 50. Examples of other root-specific promoters which may also be used to perform the methods of the invention are shown in Table 2b in the "Definitions" section above.

Concerning CLC-pKG polypeptides, advantageously, any type of promoter, whether natural or synthetic, may be used to drive expression of the nucleic acid sequence, but preferably the promoter is of plant origin. A root promoter is particularly useful in the methods. Preferably the root promoter is ubiquitous within the root. Also useful in the methods of the invention is constitutive promoter. Preferably the constitutive promoter is a ubiquitous constitutive promoter of medium strength. See the "Definitions" section herein for definitions of the various promoter types.

Concerning HD-hydrolase-like polypeptides, advantageously, any type of promoter, whether natural or synthetic, may be used to drive expression of the nucleic acid sequence, but preferably the promoter is of plant origin. A constitutive promoter is particularly useful in the methods. Preferably the constitutive promoter is a ubiquitous constitutive promoter of medium strength. See the "Definitions" section herein for definitions of the various promoter types.

Concerning SGT1 polypeptides, it should be clear that the applicability of the present invention is not restricted to the SGT1 polypeptide-encoding nucleic acid represented by SEQ ID NO: 1, nor is the applicability of the invention restricted to expression of a SGT1 polypeptide-encoding nucleic acid when driven by a root-specific promoter.

Optionally, one or more terminator sequences may be used in the construct introduced into a plant. Preferably, the construct comprises an expression cassette comprising an RCc3 promoter, substantially similar to SEQ ID NO: 50, and the nucleic acid encoding an SGT1 polypeptide.

According to a preferred feature of the invention, the modulated expression is increased expression. Methods for increasing expression of nucleic acids or genes, or gene products, are well documented in the art and examples are provided in the definitions section.

Concerning CLC-pKG polypeptides, it should be clear that the applicability of the present invention is not restricted to the CLC-pKG polypeptide-encoding nucleic acid represented by SEQ ID NO: 53, nor is the applicability of the invention restricted to expression of a CLC-pKG polypeptide-encoding nucleic acid when driven by root-specific a promoter, or when driven by a constitutive promoter.

The constitutive promoter is preferably a medium strength promoter, more preferably selected from a plant derived promoter, such as a GOS2 promoter, more preferably is the promoter GOS2 promoter from rice.

According to another preferred feature of the invention, the nucleic acid encoding a CLC-pKG polypeptide is operably linked to a root-specific promoter. The root-specific promoter is preferably an RCc3 promoter (Plant Mol Biol. 1995 January; 27(2):237-48), more preferably the RCc3 promoter is from rice, further preferably the RCc3 promoter is represented by a nucleic acid sequence substantially similar to SEQ ID NO: 115, most preferably the promoter is as represented by SEQ ID NO: 115. Examples of other root-specific promoters which may also be used to perform the methods of the invention are shown in Table 2b in the "Definitions" section above.

According to a preferred feature of the invention, the modulated expression is increased expression. Methods for increasing expression of nucleic acids or genes, or gene products, are well documented in the art and examples are provided in the definitions section.

Concerning HD-hydrolase-like polypeptides, it should be clear that the applicability of the present invention is not restricted to the HD-hydrolase-like polypeptide-encoding nucleic acid represented by SEQ ID NO: 118, nor is the applicability of the invention restricted to expression of a HD-hydrolase-like polypeptide-encoding nucleic acid when driven by a constitutive promoter.

The constitutive promoter is preferably a medium strength promoter of plant origin, such as a GOS2 promoter, more preferably the promoter is the GOS2 promoter from rice. Further preferably the constitutive promoter is represented by a nucleic acid sequence substantially similar to SEQ ID NO: 164, most preferably the constitutive promoter is as represented by SEQ ID NO: 164. See the "Definitions" section herein for further examples of constitutive promoters.

Optionally, one or more terminator sequences may be used in the construct introduced into a plant. Preferably, the construct comprises an expression cassette comprising a GOS2 promoter, substantially similar to SEQ ID NO: 164, and the nucleic acid encoding the HD-hydrolase-like polypeptide.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding an SGT1 polypeptide, or a CLC-pKG polypeptide, or a HD-hydrolase-like polypeptide, is by introducing and expressing in a plant a nucleic acid encoding an SGT1 polypeptide, or a CLC-pKG polypeptide, or a HD-hydrolase-like polypeptide respectively; however the effects of performing the method, i.e. enhancing yield-related traits may also be achieved using other well known techniques, including but not limited to T-DNA activation tagging, TILLING, homologous recombination. A description of these techniques is provided in the definitions section.

The invention also provides a method for the production of transgenic plants having enhanced yield-related traits relative to control plants, comprising introduction and expression in a plant of any nucleic acid encoding an SGT1 polypeptide, or a CLC-pKG polypeptide, or a HD-hydrolase-like polypeptide, as defined hereinabove.

More specifically, the present invention provides a method for the production of transgenic plants having enhanced yield-related traits, particularly increased (seed) yield, which method comprises:

(i) introducing and expressing in a plant or plant cell nucleic acid encoding an SGT1 polypeptide, or a CLC-pKG polypeptide, or a HD-hydrolase-like polypeptide; and (ii) cultivating the plant cell under conditions promoting plant growth and development.

The nucleic acid of (i) may be any of the nucleic acids capable of encoding an SGT1 polypeptide, or a CLC-pKG polypeptide, or a HD-hydrolase-like polypeptide, as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The present invention clearly extends to any plant cell or plant produced by any of the methods described herein, and to all plant parts and propagules thereof. The present invention encompasses plants or parts thereof (including seeds) obtainable by the methods according to the present invention. The plants or parts thereof comprise a nucleic acid transgene encoding an SGT1 polypeptide, or a CLC-pKG polypeptide, or a HD-hydrolase-like polypeptide, as defined above. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding an SGT1 polypeptide, or a CLC-pKG polypeptide, or a HD-hydrolase-like polypeptide, as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant.

Examples of crop plants include soybean, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, sorghum, emmer, spelt, secale, einkorn, teff, milo and oats.

The invention also extends to harvestable parts of a plant such as, but not limited to seeds, leaves, fruits, flowers, stems, roots, rhizomes, tubers and bulbs, which harvestable parts comprise a recombinant nucleic acid encoding an SGT1 polypeptide, or a CLC-pKG polypeptide, or a HD-hydrolase-like polypeptide. The invention furthermore relates to products derived, preferably directly derived, from a harvestable part of such a plant, such as dry pellets or powders, oil, fat and fatty acids, starch or proteins.

The present invention also encompasses use of nucleic acids encoding SGT1 polypeptides, or CLC-pKG polypeptides, or HD-hydrolase-like polypeptides, as described herein and use of these SGT1 polypeptides, or CLC-pKG polypeptides, or HD-hydrolase-like polypeptides, in enhancing any of the aforementioned yield-related traits in plants. For example, nucleic acids encoding an SGT1 polypeptide, or a CLC-pKG polypeptide, or a HD-hydrolase-like polypeptide, described herein, or the SGT1 polypeptides, or CLC-pKG polypeptides, or HD-hydrolase-like polypeptides, themselves, may find use in breeding programmes in which a DNA marker is identified which may be genetically linked to gene encoding an SGT1 polypeptide, or a CLC-pKG polypeptide, or a HD-hydrolase-like polypeptide. The nucleic acids/genes, or the SGT1 polypeptides, or CLC-pKG polypeptides, or HD-hydrolase-like polypeptides, may be used to define a molecular marker. This DNA or protein marker may then be used in breeding programmes to select plants having enhanced yield-related traits as defined hereinabove in the methods of the invention. Furthermore, allelic variants of nucleic acid/gene encoding an SGT1 polypeptide, or a CLC-pKG polypeptide, or a HD-hydrolase-like polypeptide, may find use in marker-assisted breeding programmes. Nucleic acids encoding an SGT1 polypeptide, or a CLC-pKG polypeptide, or a HD-hydrolase-like polypeptide, may also be used as probes for genetically and physically mapping the genes that they are a part of, and as markers for traits linked to those genes. Such information may be useful in plant breeding in order to develop lines with desired phenotypes.

Items

1. SGT1 Polypeptides

In one aspect, the invention is characterised by any of the following items

1. A method for enhancing yield-related traits in plants relative to control plants, comprising modulating expression in a plant of a nucleic acid encoding an SGT1 polypeptide, wherein said SGT1 polypeptide comprises the following in any order:
   (i) at least one tetratricopeptide (TPR) repeat;
   (ii) at least one CS domain; and
   (iii) an SGS domain.

2. Method according to item 1, wherein said modulated expression is effected by introducing and expressing in a plant a nucleic acid encoding an SGT1 polypeptide.

3. Method according to item 1 or 2, wherein said nucleic acid encoding an SGT1 polypeptide encodes any one of the proteins listed in Table A1 or is a portion of such a nucleic acid, or a nucleic acid capable of hybridising with such a nucleic acid.

4. Method according to any one of items 1 to 3, wherein said nucleic acid sequence encodes an orthologue or paralogue of any of the proteins given in Table A1.

5. Method according to any preceding item, wherein said enhanced yield-related traits comprise increased seed yield relative to control plants.
6. Method according to any one of items 1 to 5, wherein said enhanced yield-related traits are obtained under non-stress conditions.
7. Method according to any one of items 2 to 6, wherein said nucleic acid is operably linked to a root-specific promoter, preferably to an RCc3 promoter, most preferably to an RCc3 promoter from rice.
8. Method according to any one of items 1 to 7, wherein said nucleic acid encoding a SGT1 polypeptide is of plant origin, preferably from *Capsicum annuum* a dicotyledonous plant, further preferably from the family Solanaceae, more preferably from the genus *Capsicum*, most preferably from *Capsicum annuum*.
9. Plant or part thereof, including seeds, obtainable by a method according to any one of items 1 to 8, wherein said plant or part thereof comprises a recombinant nucleic acid encoding an SGT1 polypeptide.
10. Construct comprising:
    (i) nucleic acid encoding an SGT1 polypeptide as defined in item 1;
    (ii) one or more control sequences capable of driving expression of the nucleic acid sequence of (a); and optionally
    (iii) a transcription termination sequence.
11. Construct according to item 10, wherein one of said control sequences is a root-specific promoter, preferably an RCc3 promoter, most preferably an RCc3 promoter from rice.
12. Use of a construct according to item 10 or 11 in a method for making plants having increased yield, particularly increased seed yield relative to control plants.
13. Plant, plant part or plant cell transformed with a construct according to item 10 or 11.
14. Method for the production of a transgenic plant having increased yield, particularly increased seed yield relative to control plants, comprising:
    (i) introducing and expressing in a plant a nucleic acid encoding an SGT1 polypeptide as defined in item 1; and
    (ii) cultivating the plant cell under conditions promoting plant growth and development.
15. Transgenic plant having increased yield, particularly increased seed yield, relative to control plants, resulting from modulated expression of a nucleic acid encoding an SGT1 polypeptide as defined in item 1, or a transgenic plant cell derived from said transgenic plant.
16. Transgenic plant according to item 9, 13 or 15, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.
17. Harvestable parts of a plant according to item 16, wherein said harvestable parts are preferably shoot biomass and/or seeds.
18. Products derived from a plant according to item 16 and/or from harvestable parts of a plant according to item 17.
19. Use of a nucleic acid encoding an SGT1 polypeptide in increasing yield, particularly in increasing seed yield relative to control plants.
20. Use of a nucleic acid encoding an SGT1 polypeptide as a molecular marker for plants having increased yield, particularly increased seed yield.
2. CLC-pKG Polypeptides
In another aspect, the invention is characterised by any of the following items 1. A method for enhancing yield-related traits in plants relative to control plants, comprising modulating expression in a plant of a nucleic acid encoding a CLC-pKG polypeptide, wherein said CLC-pKG polypeptide comprises a Voltage_CLC domain (Pfam entry PF00654) and a CBS domain (Pfam entry PF00571) and optionally a USP domain (PF00582).
2. Method according to item 1, wherein said CLC-pKG polypeptide comprises a domain having in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to:
    (i) a CLC in SEQ ID NO: 54 as represented by the sequence located between amino acids 77 and 422 of SEQ ID NO: 54;
    (ii) a CBS domain in SEQ ID NO: 54 as represented by the sequence located between amino acids 455 to 510 or 516 to 571 SEQ ID NO: 54; and optionally
    (iii) a USP domain in SEQ ID NO: 54 as represented by the sequence located between amino acids 597-731 of SEQ ID NO: 54.
3. Method according to item 1 or 2, wherein said modulated expression is effected by introducing and expressing in a plant a genetic construct comprising a nucleic acid encoding a CLC-pKG polypeptide.
4. Method according to any one of items 1 to 3, wherein said nucleic acid encoding a CLC-pKG polypeptide encodes any one of the proteins listed in Table A2 or is a portion of such a nucleic acid, or a nucleic acid capable of hybridising with such a nucleic acid.
5. Method according to any one of items 1 to 4, wherein said nucleic acid encodes an orthologue or paralogue of any of the proteins given in Table A2.
6. Method according to any preceding item, wherein said enhanced yield-related traits comprise increased yield, preferably increased biomass and/or increased seed yield relative to control plants.
7. Method according to any one of items 1 to 6, wherein said enhanced yield-related traits are obtained under non-stress conditions or under conditions of drought stress, or salt stress.
8. Method according to any one of items 3 to 7, wherein said nucleic acid is operably linked to a constitutive promoter, preferably to a RCc3 promoter, most preferably to a RCc3 promoter from rice.
9. Method according to any one of items 1 to 8, wherein said nucleic acid encoding a CLC-pKG polypeptide is of cyanobacterial origin, further preferably from Synechosystis species, more preferably from *Synechocystis* sp. PCC 6803.
10. Plant or part thereof, including seeds, obtainable by a method according to any one of items 1 to 9, wherein said plant or part thereof comprises a recombinant nucleic acid encoding a CLC-pKG polypeptide.
11. Construct comprising:
    (i) nucleic acid encoding a CLC-pKG polypeptide as defined in items 1 or 2;
    (ii) one or more control sequences capable of driving expression of the nucleic acid sequence of (a); and optionally
    (iii) a transcription termination sequence.

12. Construct according to item 11, wherein one of said control sequences is a constitutive promoter, preferably a RCc3 promoter, most preferably a RCc3 promoter from rice.
13. Use of a construct according to item 11 or 12 in a method for making plants having increased yield, particularly increased biomass and/or increased seed yield relative to control plants.
14. Plant, plant part or plant cell transformed with a construct according to item 11 or 12.
15. Method for the production of a transgenic plant having increased yield, particularly increased biomass and/or increased seed yield relative to control plants, comprising:
    (i) introducing and expressing in a plant a nucleic acid encoding a CLC-pKG polypeptide as defined in item 1 or 2; and
    (ii) cultivating the plant cell under conditions promoting plant growth and development.
16. Transgenic plant having increased yield, particularly increased biomass and/or increased seed yield, relative to control plants, resulting from modulated expression of a recombinant nucleic acid encoding a CLC-pKG polypeptide as defined in item 1 or 2, or a transgenic plant cell derived from said transgenic plant.
17. Transgenic plant according to item 10, 14 or 16, or a transgenic plant cell derived thereof, wherein said plant is a crop plant or a monocot or a cereal, such as rice, maize, wheat, barley, millet, rye, triticale, sorghum emmer, spelt, *secale*, einkorn, teff, milo and oats.
18. Harvestable parts of a plant according to item 17, wherein said harvestable parts are preferably shoot biomass and/or seeds.
19. Products derived from a plant according to item 17 and/or from harvestable parts of a plant according to item 18.
20. Use of a genetic construct comprising a nucleic acid encoding a CLC-pKG polypeptide in increasing yield, particularly in increasing seed yield and/or shoot biomass in plants, relative to control plants.

3. HD-Hydrolase-Like Polypeptides

In yet another aspect, the invention is characterised by any of the following items
1. A method for enhancing yield-related traits in plants relative to control plants, comprising modulating expression in a plant of a nucleic acid encoding a HD-hydrolase-like polypeptide, wherein said HD-hydrolase-like polypeptide comprises a CRISPR-associated protein Crm2 domain.
2. Method according to item 1, wherein said HD-hydrolase-like polypeptide comprises one or more of the motifs 11 to 26.
3. Method according to item 1 or 2, wherein said modulated expression is effected by introducing and expressing in a plant a nucleic acid encoding a HD-hydrolase-like polypeptide.
4. Method according to any one of items 1 to 3, wherein said nucleic acid encoding a HD-hydrolase-like polypeptide encodes any one of the proteins listed in Table A3 or is a portion of such a nucleic acid, or a nucleic acid capable of hybridising with such a nucleic acid.
5. Method according to any one of items 1 to 4, wherein said nucleic acid sequence encodes an orthologue or paralogue of any of the proteins given in Table A3.
6. Method according to any preceding item, wherein said enhanced yield-related traits comprise increased yield, preferably increased biomass and/or increased seed yield relative to control plants.
7. Method according to any one of items 1 to 6, wherein said enhanced yield-related traits are obtained under non-stress conditions.
8. Method according to any one of items 3 to 7, wherein said nucleic acid is operably linked to a constitutive promoter, preferably to a GOS2 promoter, most preferably to a GOS2 promoter from rice.
9. Method according to any one of items 1 to 8, wherein said nucleic acid encoding a HD-hydrolase-like polypeptide is of plant origin, preferably from a cyanophyte, further preferably from the family Chroococcaceae, more preferably from the genus *Synechocystis*.
10. Plant or part thereof, including seeds, obtainable by a method according to any one of items 1 to 9, wherein said plant or part thereof comprises a recombinant nucleic acid encoding a HD-hydrolase-like polypeptide.
11. Construct comprising:
    (i) nucleic acid encoding a HD-hydrolase-like polypeptide as defined in items 1 or 2;
    (ii) one or more control sequences capable of driving expression of the nucleic acid sequence of (a); and optionally
    (iii) a transcription termination sequence.
12. Construct according to item 11, wherein one of said control sequences is a constitutive promoter, preferably a GOS2 promoter, most preferably a GOS2 promoter from rice.
13. Use of a construct according to item 11 or 12 in a method for making plants having increased yield, particularly increased biomass and/or increased seed yield relative to control plants.
14. Plant, plant part or plant cell transformed with a construct according to item 11 or 12.
15. Method for the production of a transgenic plant having increased yield, particularly increased biomass and/or increased seed yield relative to control plants, comprising:
    (i) introducing and expressing in a plant a nucleic acid encoding a HD-hydrolase-like polypeptide as defined in item 1 or 2; and
    (ii) cultivating the plant cell under conditions promoting plant growth and development.
16. Transgenic plant having increased yield, particularly increased biomass and/or increased seed yield, relative to control plants, resulting from modulated expression of a nucleic acid encoding a HD-hydrolase-like polypeptide as defined in item 1 or 2, or a transgenic plant cell derived from said transgenic plant.
17. Transgenic plant according to item 10, 14 or 16, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.
18. Harvestable parts of a plant according to item 17, wherein said harvestable parts are preferably shoot biomass and/or seeds.
19. Products derived from a plant according to item 17 and/or from harvestable parts of a plant according to item 18.
20. Use of a nucleic acid encoding a HD-hydrolase-like polypeptide in increasing yield, particularly in increasing seed yield and/or shoot biomass in plants, relative to control plants.

DESCRIPTION OF FIGURES

The present invention will now be described with reference to the following figures in which:

FIG. 1 represents a multiple alignment of various SGT1 polypeptides. Alignment of polypeptide sequences was performed using the ClustalW 2.0 algorithm of progressive alignment (Thompson et al. (1997) Nucleic Acids Res 25:4876-4882; Chema et al. (2003). Nucleic Acids Res 31:3497-3500) with standard setting (slow alignment, similarity matrix: Gonnet, gap opening penalty 10, gap extension penalty: 0.2). Minor manual editing was done to further optimise the alignment. The SGT1 polypeptides are aligned in FIG. 2.

A.thaliana_AT4G23570.1#1: SEQ ID NO: 4; A.thaliana_AT4G23570.2#1: SEQ ID NO: 6;
A.thaliana_AT4G23570.3#1: SEQ ID NO: 10; A.thaliana_AT4G11260.1#1: SEQ ID NO: 8;
B.napus_BN06MC26625_51284379@2: SEQ ID NO: 12;
Z.mays_ZM07MC27211_BFb0187N13@: SEQ ID NO: 34;
Z.mays_ZM07MC23831_BFb0038K08@: SEQ ID NO: 36; O.sativa_LOC_Os01g43540.1#1:
SEQ ID NO: 20; T.aestivum_TC280790#1: SEQ ID NO: 32; M.truncatula_CT025844_7.4#1:
ID NO: 18; G.max_GM06MC38560_sab91h08@375: SEQ ID NO: 14;
TraitMillCDS_25598_CDS6534_69_: SEQ ID NO: 2; SGT1_from_Pepper_KOGENT2_: SEQ
ID NO: 2; S.lycopersicum_TC192025#1: SEQ ID NO: 26; S.lycopersicum_NP9243669#1: SEQ ID NO: 28; P.trichocarpa_scaff_IV.839#1: SEQ ID NO: 22; P.trichocarpa_scaff_44.273#1: SEQ ID NO: 24; S.lycopersicum_AW398985#1: SEQ ID NO: 30; and H.vulgare_c62589592hv270303@64: SEQ ID NO: 16.

Figure 2:
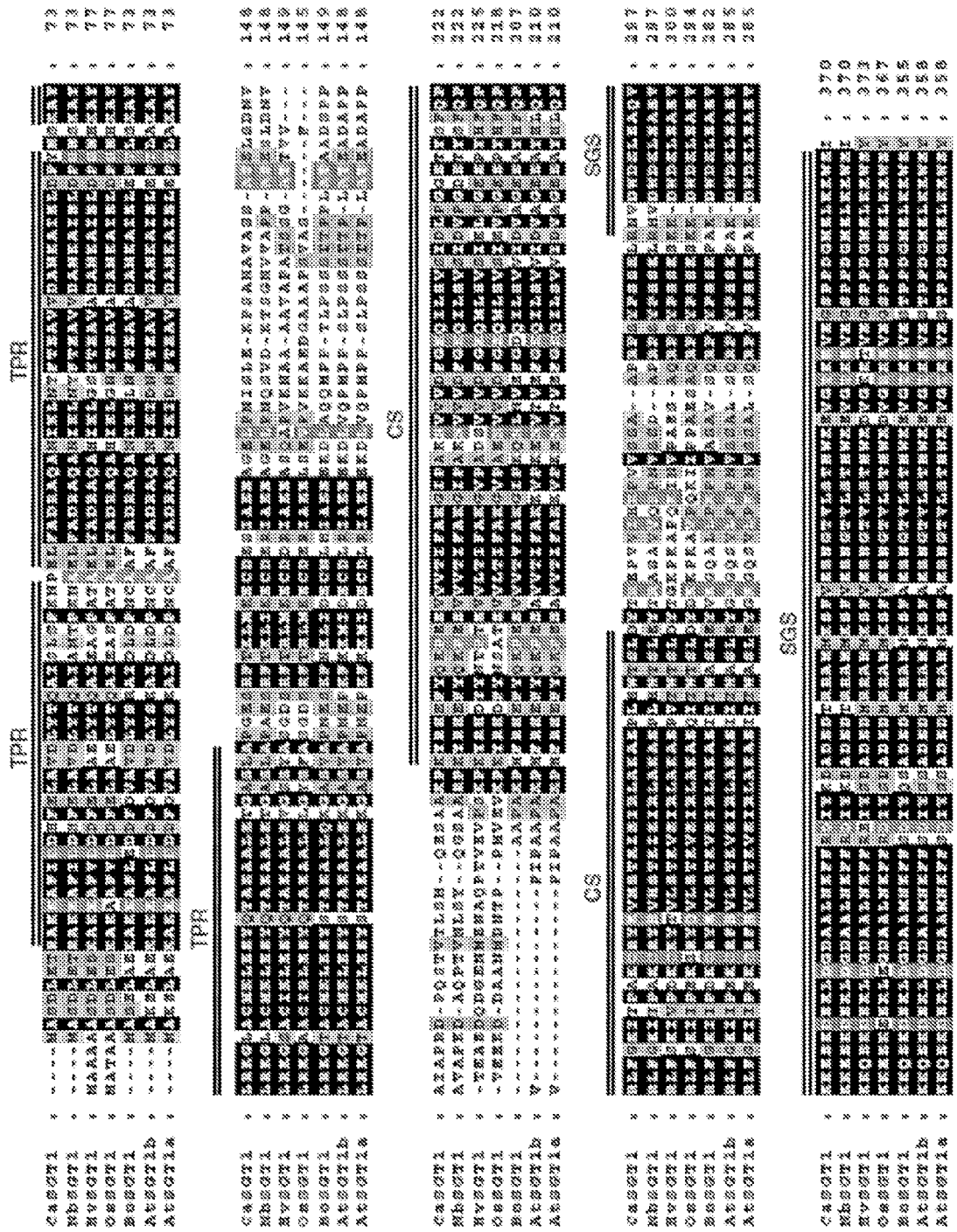

FIG. 2 shows a further alignment highlighting the conserved domains common to SGT1 polypeptides. CaSGT1: SEQ ID NO: 167; NbSGT1: SEQ ID NO: 168; HvSGT1: SEQ ID NO: 169; OsSGT1: SEQ ID NO: 170; BoSGT1: SEQ ID NO: 171; AtSGT1b: SEQ ID NO: 172; and AtSGT1a: SEQ ID NO: 173.

Figure 3:
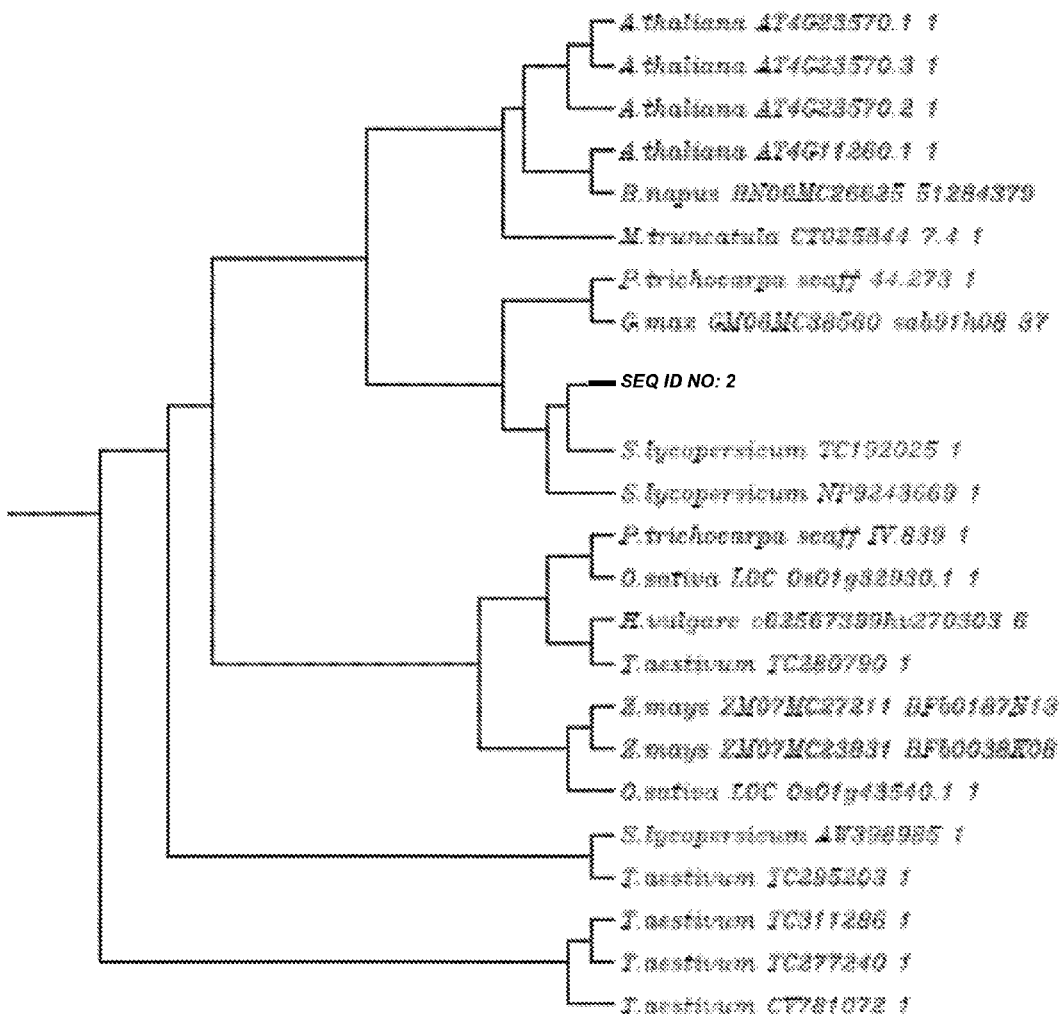

FIG. 3 shows a phylogenetic tree of SGT1 polypeptides constructed using a neighbour-joining clustering algorithm as provided in the AlignX programme from the Vector NTI (Invitrogen).

Figure 4:
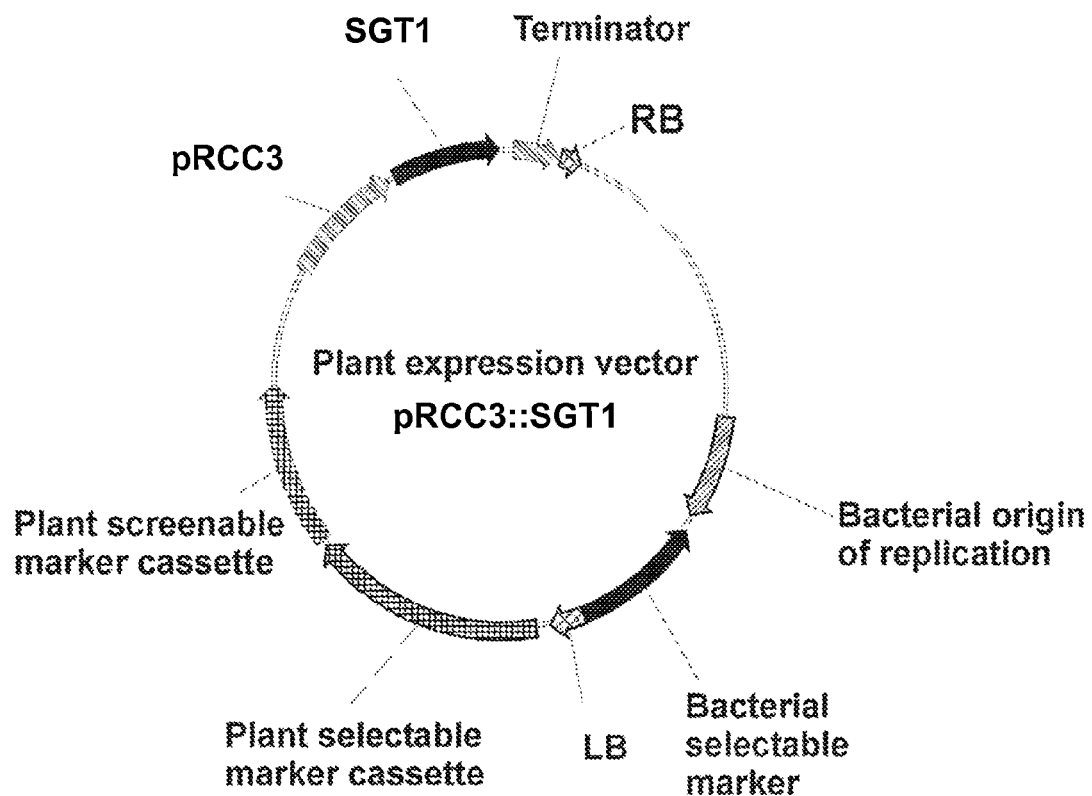

FIG. 4 represents the binary vector used for increased expression in *Oryza sativa* of an SGT1-encoding nucleic acid under the control of a rice RCc3 promoter (pRCc3).

FIG. 5 represents a multiple alignment of various CLC-pKG polypeptides. The asterisks indicate identical amino acids among the various protein sequences, colons represent highly conserved amino acid substitutions, and the dots represent less conserved amino acid substitution; on other positions there is no sequence conservation. These alignments can be used for defining further motifs, when using conserved amino acids.

gi|218440518|ref|YP_002378847.: SEQ ID NO: 56;
gi|196258397|ref|ZP_03156931.1: SEQ ID NO: 58;
gi|126659209|ref|ZP_01730347.1: SEQ ID NO: 60;
gi|172034995|ref|YP_001801496.: SEQ ID NO: 62;
gi|67923321|ref|ZP_00516804.1|: SEQ ID NO: 66;
gi|218248189|ref|YP_002373560.: SEQ ID NO: 64;
gi|159026894|emb|CAO89145.1|_e: SEQ ID NO: 68;
gi|166366612|ref|YP_001658885.: SEQ ID NO: 70;
gi|16331172|ref|NP_441900.1|_c: SEQ ID NO: 54;
gi|170077188|ref|YP_001733826.: SEQ ID NO: 72;
gi|158334130|ref|YP_001515302.: SEQ ID NO: 108;
gi|11951030|ref|ZP_01629437.1: SEQ ID NO: 74;
gi|186682049|ref|YP_001865245.: SEQ ID NO: 96;
gi|75908381|ref|YP_322677.1 |_C: SEQ ID NO: 90;
gi|17232383|ref|NP_488931.1|h: SEQ ID NO: 92;
gi|225516217|ref|ZP_03763190.1.: SEQ ID NO: 98;
gi|254413597|ref|ZP_05027367.1: SEQ ID NO: 76;
gi|186683293|ref|YP_001866489.: SEQ ID NO: 78;
gi|225522175|ref|ZP_03768989.1: SEQ ID NO: 86;
gi|186682226|ref|YP_001865422.: SEQ ID NO: 88;
gi|220909579|ref|YP_002484890.: SEQ ID NO: 102;
gi|37523751|ref|NP_927128.1|_c: SEQ ID NO: 104;
gi|119486852|ref|ZP_01620827.1: SEQ ID NO: 100;
gi|209525724|ref|ZP_03274261.1: SEQ ID NO: 106;
gi|220908306|ref|YP_002483617.: SEQ ID NO: 110; and
gi|81300397|ref|YP_400605.1|_C: SEQ ID NO: 112.

Figure 6:
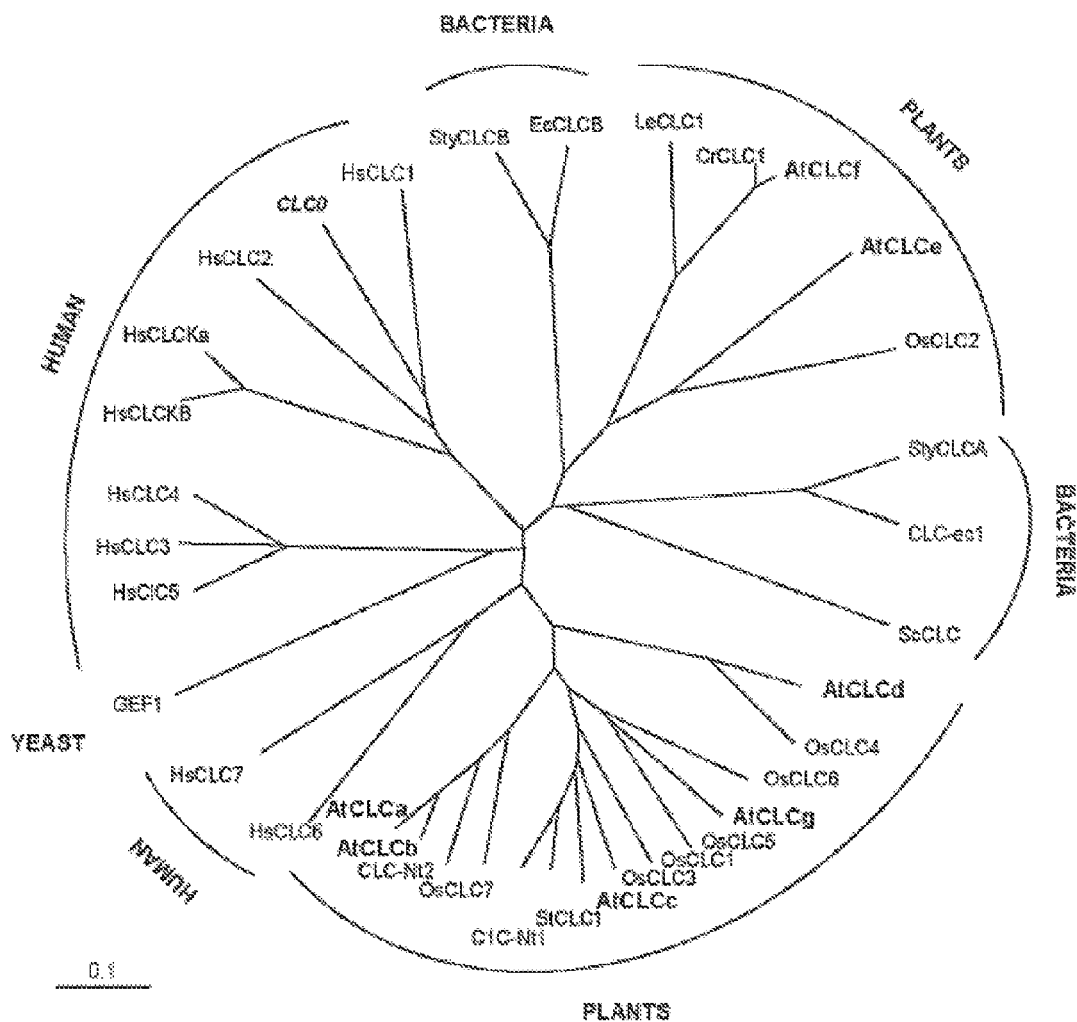

FIG. 6 shows phylogenetic tree of CLC-pKG polypeptides.

Figure 7:
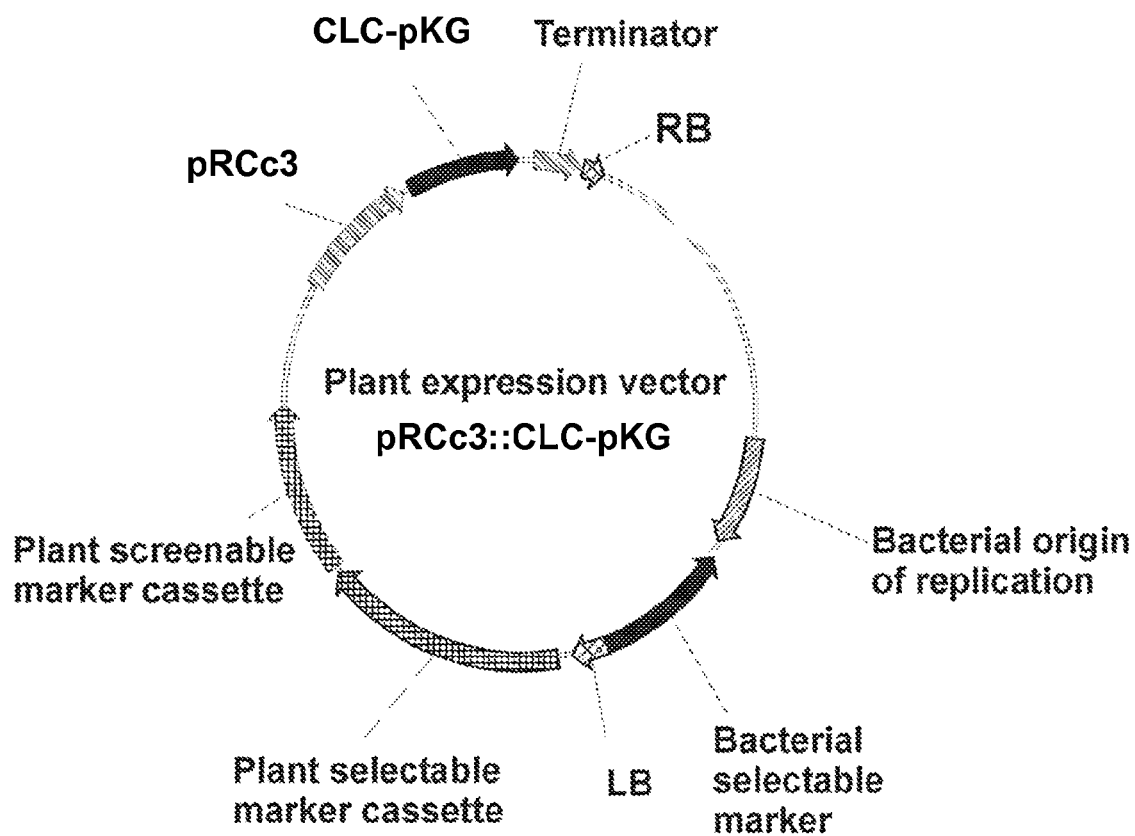

FIG. 7 represents the binary vector used for increased expression in *Oryza sativa* of a CLC-PKG-encoding nucleic acid under the control of a rice RCc3 promoter (pRCc3).

FIG. 8 represents the domain structure of SEQ ID NO: 119 with conserved motifs 11 to 26, underlined and numbered. The CRISPR-associated protein Crm2 (IPR013407) domain is shown in bold.

FIG. 9 represents a multiple alignment of various HD-hydrolase-like polypeptides. The asterisks indicate identical amino acids among the various protein sequences, colons represent highly conserved amino acid substitutions, and the dots represent less conserved amino acid substitution; on other positions there is no sequence conservation. These alignments can be used for defining further motifs, when using conserved amino acids.

gi|21997427|ref|YP_001002214.: SEQ ID NO: 133;
gi|88810314|ref|ZP_01125571.1|: SEQ ID NO: 147;
gi|255254649|ref|ZP_05334193.1: SEQ ID NO: 135;
gi|255338062|ref|ZP_05378933.1: SEQ ID NO: 137;
gi|20808984|ref|NP_624155.1|_h: SEQ ID NO: 139;
gi|254478158|ref|ZP_05091540.1: SEQ ID NO: 141;
gi|38505758|ref|NP_942378.1|h:
SEQ ID NO: 119; gi|170079601|ref|YP_001736234.: SEQ ID NO: 121;
gi|126661502|ref|ZP_01732553.1: SEQ ID NO: 125;
gi|172035267|ref|YP_001801768.: SEQ ID NO: 127;
gi|86608324|ref|YP_477086.1|C: SEQ ID NO: 123;
gi|86607166|ref|YP_475929.1|C: SEQ ID NO: 129;
gi|255256456|ref|ZP_05335917.1: SEQ ID NO: 145;
gi|209526382|ref|ZP_03274910.1: SEQ ID NO: 131; and
gi|162453956|ref|YP_001616323.: SEQ ID NO: 143.

Figure 10:
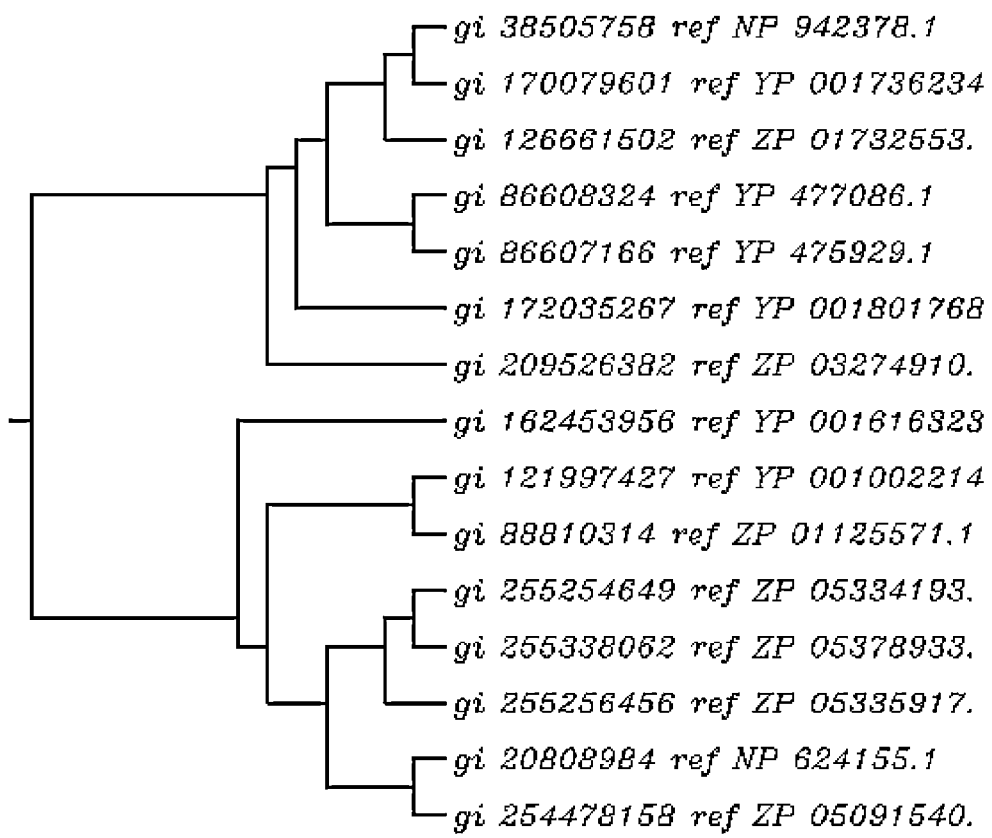

FIG. 10 shows phylogenetic tree of HD-hydrolase-like polypeptides. The identifiers are the accession numbers as provided for the proteins in the sequence listing.

Figure 11:
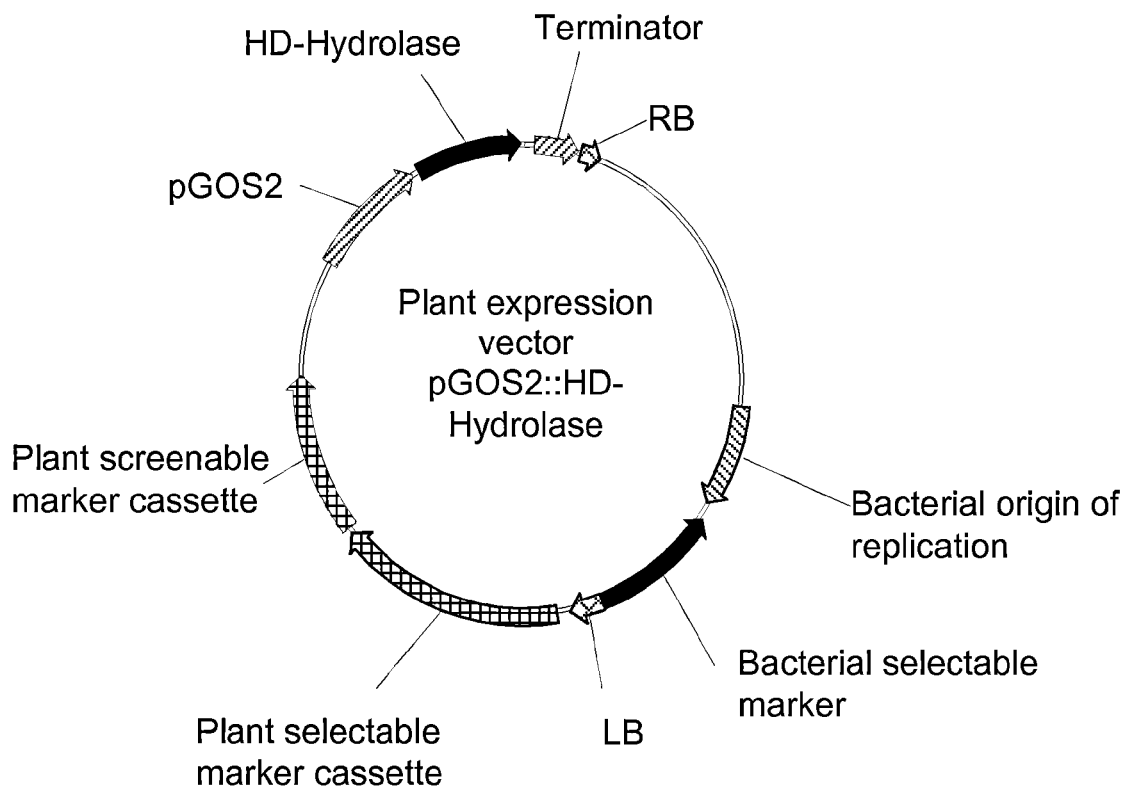

FIG. 11 represents the binary vector used for increased expression in *Oryza sativa* of a HD-hydrolase-like-encoding nucleic acid under the control of a rice GOS2 promoter (pGOS2).

EXAMPLES

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax

Example 1

Identification of Sequences Related to the Nucleic Acid Sequence Used in the Methods of the Invention 1. SGT1 Polypeptides Sequences (full length cDNA, ESTs or genomic) related to SEQ ID NO: 1 and SEQ ID NO: 2 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SEQ ID NO: 1 was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

Table A1 provides a list of nucleic acid sequences related to SEQ ID NO: 1 and SEQ ID NO: 2.

Sequences have been tentatively assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. Special nucleic acid sequence databases have been created for particular organisms, such as by the Joint Genome Institute.

2. CLC-pKG Polypeptides

Sequences (full length cDNA, ESTs or genomic) related to SEQ ID NO: 53 and SEQ ID NO: 54 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SEQ ID NO: 53 was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

Table A2 provides a list of nucleic acid sequences and polypeptides related to SEQ ID NO: 53 and SEQ ID NO: 54.

TABLE A1

Examples of SGT1 nucleic acids and polypeptides

| Name | Nucleic acid SEQ ID NO: | Polypeptide SEQ ID NO: |
|---|---|---|
| SGT1 from Pepper | 1 | 2 |
| A.thaliana_AT4G23570.1#1 | 3 | 4 |
| A.thaliana_AT4G23570.2#1 | 5 | 6 |
| A.thaliana_AT4G11260.1#1 | 7 | 8 |
| A.thaliana_AT4G23570.3#1 | 9 | 10 |
| B.napus_BN06MC26625_51284379@26524#1 | 11 | 12 |
| G.max_GM06MC38560_sab91h08@37598#1 | 13 | 14 |
| H.vulgare_c62589592hv270303@6491#1 | 15 | 16 |
| M.truncatula_CT025844_7.4#1 | 17 | 18 |
| O.sativa_LOC_Os01g43540.1#1 | 19 | 20 |
| P.trichocarpa_scaff_IV.839#1 | 21 | 22 |
| P.trichocarpa_scaff_44.273#1 | 23 | 24 |
| S.lycopersicum_TC192025#1 | 25 | 26 |
| S.lycopersicum_NP9243669#1 | 27 | 28 |
| S.lycopersicum_AW398985#1 | 29 | 30 |
| T.aestivum_TC280790#1 | 31 | 32 |
| Z.mays_ZM07MC27211_BFb0187N13@27130#1 | 33 | 34 |
| Z.mays_ZM07MC23831_BFb0038K08@23765#1 | 35 | 36 |

TABLE A2

Examples of CLC-pKG polypeptides

| Organism | Nucleic acid name | Nucleic acid SEQ ID NO |
|---|---|---|
| Synechocystis sp. PCC 6803] | gi|16329170: 2216476-2219175 | 53 |
| Cyanothece sp. PCC 7424] | gi|218437013: 4004295-4006922 | 55 |
| Cyanothece sp. PCC 7822] | gi|196258358: 38011-40635 | 57 |
| Cyanothece sp. CCY0110] | gi|126659182: 36041-38674 | 59 |
| Cyanothece sp. ATCC 51142] | gi|172034917: 71619-74267 | 61 |
| Cyanothece sp. PCC 8801] | gi|218244892: 3580780-3583419 | 63 |
| Crocosphaera watsonii WH 8501] | gi|67923302: 15782-18430 | 65 |
| Microcystis aeruginosa PCC 7806] | gi|159026870: 19707-22334 | 67 |
| Microcystis aeruginosa NIES-843] | gi|166362741: 3545508-3548135 | 69 |
| Synechococcus sp. PCC 7002] | gi|170076636: 589624-592260 | 71 |
| Nodularia spumigena CCY9414] | gi|119510275: 28473-31136 | 73 |
| Microcoleus chthonoplastes PCC 7420] | gi|254413420: 221158-223773 | 75 |
| Nostoc punctiforme PCC 73102] | gi|186680550: 3804594-3807185 | 77 |
| Nostoc punctiforme PCC 73102] | gi|186680550: 2232857-2235448 | 79 |

TABLE A2-continued

Examples of CLC-pKG polypeptides

| Anabaena variabilis ATCC 29413] | gi|75906225: 2674416-2677004 | 81 |
|---|---|---|
| Nostoc sp. PCC 7120] | gi|17227497: 5827615-5830230 | 83 |
| 'Nostoc azollae' 0708] | gi|225522173: 3082-5673 | 85 |
| Nostoc punctiforme PCC 73102] | gi|186680550: 2232857-2235448 | 87 |
| Anabaena variabilis ATCC 29413] | gi|75906225: 2674416-2677004 | 89 |
| Nostoc sp. PCC 7120] | gi|17227497: 5827615-5830230 | 91 |
| 'Nostoc azollae' 0708] | gi|225522173: 3082-5673 | 93 |
| Nostoc punctiforme PCC 73102] | gi|186680550: 1989068-1991719 | 95 |
| 'Nostoc azollae' 0708] | gi|225516157: 49369-51948 | 97 |
| Lyngbya sp. PCC 8106] | gi|119486739: 136813-139515 | 99 |
| Cyanothece sp. PCC 7425] | gi|220905643: 4270175-4272766 | 101 |
| Gloeobacter violaceus PCC 7421] | gi|37519569: 4380220-4382796 | 103 |
| Arthrospira maxima CS-328] | gi|209525652: 71572-74244 | 105 |
| Acaryochloris marina MBIC11017] | gi|158333233: 913406-916021 | 107 |
| Cyanothece sp. PCC 7425] | gi|220905643: 2873784-2876477 | 109 |
| Synechococcus elongatus PCC 7942] | gi|81298811: 1653255-1655834 | 111 |

| Organism | Polypeptide name | Polypeptide SEQ ID NO |
|---|---|---|
| Synechocystis sp. PCC 6803] | gi|16331172|ref|NP_441900 | 54 |
| Cyanothece sp. PCC 7424] | gi|218440518|ref|YP_002378847 | 56 |
| Cyanothece sp. PCC 7822] | gi|196258397|ref|ZP_03156931 | 58 |
| Cyanothece sp. CCY0110] | gi|126659209|ref|ZP_01730347 | 60 |
| Cyanothece sp. ATCC 51142] | gi|172034995|ref|YP_001801496 | 62 |
| Cyanothece sp. PCC 8801] | gi|218248189|ref|YP_002373560 | 64 |
| Crocosphaera watsonii WH 8501] | gi|67923321|ref|ZP_00516804 | 66 |
| Microcystis aeruginosa PCC 7806] | gi|159026894|ref|CAO89145 | 68 |
| Microcystis aeruginosa NIES-843] | gi|166366612|ref|YP_001658885 | 70 |
| Synechococcus sp. PCC 7002] | gi|170077188|ref|YP_001733826 | 72 |
| Nodularia spumigena CCY9414] | gi|119510301|ref|ZP_01629437 | 74 |
| Microcoleus chthonoplastes PCC 7420] | gi|254413597|ref|ZP_05027367 | 76 |
| Nostoc punctiforme PCC 73102] | gi|186683293|ref|YP_001866489 | 78 |
| Nostoc punctiforme PCC 73102] | gi|186682226|ref|YP_001865422 | 80 |
| Anabaena variabilis ATCC 29413] | gi|75908381|ref|YP_322677 | 82 |
| Nostoc sp. PCC 7120] | gi|7232383|ref|NP_488931 | 84 |
| 'Nostoc azollae' 0708] | gi|225522175|ref|ZP_03768989 | 86 |
| Nostoc punctiforme PCC 73102] | gi|186682226|ref|YP_001865422 | 88 |
| Anabaena variabilis ATCC 29413] | gi|75908381|ref|YP_322677 | 90 |
| Nostoc sp. PCC 7120] | gi|7232383|ref|NP_488931 | 92 |
| 'Nostoc azollae' 0708] | gi|225522175|ref|ZP_03768989 | 94 |
| Nostoc punctiforme PCC 73102] | gi|186682049|ref|YP_001865245 | 96 |
| 'Nostoc azollae' 0708] | gi|225516217|ref|ZP_03763190 | 98 |
| Lyngbya sp. PCC 8106] | gi|119486852|ref|ZP_01620827 | 100 |
| Cyanothece sp. PCC 7425] | gi|220909579|ref|YP_002484890 | 102 |
| Gloeobacter violaceus PCC 7421] | gi|37523751|ref|NP_927128 | 104 |
| Arthrospira maxima CS-328] | gi|209525724|ref|ZP_03274261 | 106 |
| Acaryochloris marina MBIC11017] | gi|158334130|ref|YP_001515302 | 108 |
| Cyanothece sp. PCC 7425] | gi|220908306|ref|YP_002483617 | 110 |
| Synechococcus elongatus PCC 7942] | gi|181300397|ref|YP_400605 | 112 |

Sequences have been tentatively assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. Special nucleic acid sequence databases have been created for particular organisms, such as by the Joint Genome Institute. Furthermore, access to proprietary databases, has allowed the identification of novel nucleic acid and polypeptide sequences.

3. HD-Hydrolase-Like Polypeptides

Sequences (full length cDNA, ESTs or genomic) related to SEQ ID NO: 118 and SEQ ID NO: 119 were identified amongst those maintained in the Entrez Nucleotides database at the National Center for Biotechnology Information (NCBI) using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SEQ ID NO: 118 was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

Table A3 provides a list of nucleic acid sequences related to SEQ ID NO: 118 and SEQ ID NO: 119.

TABLE A3

Examples of HD-hydrolase-like nucleic acids and polypeptides

| Name | Source | Nucleic acid SEQ ID NO: | Polypeptide SEQ ID NO: |
|---|---|---|---|
| NP_942378.1 | Synechocystis sp. | 118 | 119 |
| YP_001736234.1 | Synechococcus sp. | 120 | 121 |
| YP_477086.1 | Synechococcus sp. | 122 | 123 |
| ZP_01732553.1 | Cyanothece sp. | 124 | 125 |
| YP_001801768.1 | Cyanothece sp. | 126 | 127 |
| YP_475929.1 | Synechococcus sp. | 128 | 129 |
| ZP_03274910.1 | Arthrospira maxima | 130 | 131 |
| YP_001002214.1 | Halorhodospira halophila | 132 | 133 |
| ZP_05334193.1 | Thermoanaerobacter italicus | 134 | 135 |
| ZP_05378933.1 | Thermoanaerobacter mathranii subsp. Mathranii | 136 | 137 |
| NP_624155.1 | Thermoanaerobacter tengcongensis | 138 | 139 |
| ZP_05091540.1 | Carboxydibrachium pacificum | 140 | 141 |
| YP_001616323.1 | Sorangium cellulosum | 142 | 143 |
| ZP_05335917.1 | Thermoanaerobacterium thermosaccharolyticum | 144 | 145 |
| ZP_01125571.1 | Nitrococcus mobilis | 146 | 147 |

Sequences have been tentatively assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. Special nucleic acid sequence databases have been created for particular organisms, such as by the Joint Genome Institute. Furthermore, access to proprietary databases, has allowed the identification of novel nucleic acid and polypeptide sequences.

Example 2

Alignment of Sequences Related to the Polypeptide Sequences Used in the Methods of the Invention 1. SGT1 Polypeptides Alignment of polypeptide sequences was performed using the ClustalW 2.0 algorithm of progressive alignment (Thompson et al. (1997) Nucleic Acids Res 25:4876-4882; Chenna et al. (2003). Nucleic Acids Res 31:3497-3500) with standard setting (slow alignment, similarity matrix: Gonnet, gap opening penalty 10, gap extension penalty: 0.2). Minor manual editing was done to further optimise the alignment. The SGT1 polypeptides are aligned in FIGS. 1 and 2.

A phylogenetic tree of SGT1 polypeptides (FIG. 3) was constructed using a neighbour-joining clustering algorithm as provided in the AlignX programme from the Vector NTI (Invitrogen).

2. CLC-pKG Polypeptides

Alignment of polypeptide sequences was performed using the ClustalW 1.8 algorithm of progressive alignment (Thompson et al. (1997) Nucleic Acids Res 25:4876-4882; Chenna et al. (2003). Nucleic Acids Res 31:3497-3500) with standard setting (slow alignment, similarity matrix: Blosum 62, gap opening penalty 10, gap extension penalty: 0.2). Minor manual editing was done to further optimise the alignment. The CLC-pKG polypeptides are aligned in FIG. 5.

A phylogenetic tree of CLC-pKG polypeptides (FIG. 6) was taken from Marmagne et al. 2007.

3. HD-Hydrolase-Like Polypeptides

Alignment of polypeptide sequences was performed using the ClustalW 1.81 algorithm of progressive alignment (Thompson et al. (1997) Nucleic Acids Res 25:4876-4882; Chenna et al. (2003). Nucleic Acids Res 31:3497-3500) with standard setting (slow alignment, similarity matrix: Gonnet, gap opening penalty 10, gap extension penalty: 0.2). Minor manual editing was done to further optimise the alignment.

A phylogenetic tree of HD-hydrolase-like polypeptides (FIG. 10) was constructed using a neighbour-joining clustering algorithm as provided in the AlignX program of Vector NTI (Invitrogen).

Example 3

Calculation of Global Percentage Identity Between Polypeptide Sequences Useful in Performing the Methods of the Invention 1. SGT1 Polypeptides Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix.

Parameters used in the comparison are: Scoring matrix: Blosum62, First Gap: 12, Extending Gap: 2.

A MATGAT table for local alignment of a specific domain, or data on % identity/similarity between specific domains may also be performed.

2. CLC-pKG Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Parameters typically used in the comparisons are: Scoring matrix: Blosum62, First Gap: 12, Extending Gap: 2.

3. HD-Hydrolase-Like Polypeptides

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were: Scoring matrix: Blosum62, First Gap: 12, Extending Gap: 2.

Results of the software analysis are shown in Table B1 for the global similarity and identity over the full length of the polypeptide sequences. The sequence identity (in %) between the HD-hydrolase-like polypeptide sequences useful in performing the methods of the invention can be as low as 17% compared to SEQ ID NO: 118 (NP_942378.1).

TABLE B1

MatGAT results for global similarity and identity over the full length of the polypeptide sequences.

| | 1 | 2 | 3 | 4 | 5 | 6 | 7 | 8 | 9 | 10 | 11 | 12 | 13 | 14 | 15 |
|---|---|---|---|---|---|---|---|---|---|---|---|---|---|---|---|
| 1. NP_942378.1 | | 68.1 | 48.3 | 51.5 | 47.2 | 48.3 | 27.2 | 19.6 | 23.6 | 23.5 | 21.5 | 21.5 | 17.2 | 20.5 | 20.4 |
| 2. YP_001736234.1 | 80.1 | | 46.4 | 50.7 | 46.7 | 49.3 | 27.9 | 19.7 | 25.5 | 24.5 | 21.0 | 20.9 | 19.9 | 22.6 | 22.8 |
| 3. ZP_01732553.1 | 61.8 | 61.0 | | 44.7 | 45.5 | 44.0 | 25.7 | 15.4 | 19.4 | 18.9 | 21.2 | 21.3 | 22.2 | 19.0 | 18.9 |
| 4. YP_477086.1 | 66.7 | 66.2 | 59.3 | | 78.1 | 47.5 | 28.2 | 21.2 | 26.0 | 24.0 | 21.2 | 21.2 | 18.1 | 21.5 | 21.0 |
| 5. YP_475929.1 | 62.6 | 60.9 | 61.2 | 83.8 | | 44.2 | 27.9 | 20.8 | 24.3 | 23.6 | 20.1 | 20.0 | 17.5 | 20.6 | 20.3 |
| 6. YP_001801768.1 | 63.5 | 64.4 | 58.2 | 65.1 | 59.6 | | 26.7 | 19.5 | 23.4 | 22.4 | 22.9 | 21.9 | 18.7 | 20.9 | 20.4 |
| 7. ZP_03274910.1 | 44.6 | 46.3 | 40.4 | 47.1 | 44.8 | 47.9 | | 18.7 | 21.8 | 19.9 | 19.3 | 19.4 | 17.7 | 20.5 | 20.1 |
| 8. YP_001616323.1 | 33.7 | 34.1 | 28.4 | 34.3 | 32.7 | 35.1 | 33.9 | | 24.1 | 23.4 | 18.3 | 18.3 | 15.4 | 20.1 | 20.2 |
| 9. YP_001002214.1 | 42.2 | 41.8 | 36.0 | 41.7 | 39.4 | 40.3 | 37.5 | 34.6 | | 56.1 | 25.4 | 25.5 | 20.2 | 26.3 | 26.6 |
| 10. ZP_01125571.1 | 38.8 | 40.5 | 35.4 | 40.8 | 40.3 | 39.1 | 36.2 | 35.9 | 66.8 | | 24.9 | 24.8 | 19.6 | 26.7 | 27.2 |
| 11. ZP_05334193.1 | 39.4 | 39.8 | 39.8 | 41.2 | 40.4 | 41.4 | 35.6 | 34.3 | 42.9 | 45.5 | | 99.4 | 29.2 | 26.3 | 26.7 |
| 12. ZP_05378933.1 | 39.1 | 39.7 | 40.4 | 40.9 | 40.5 | 41.8 | 35.6 | 34.2 | 43.0 | 45.6 | 99.8 | | 29.3 | 26.4 | 26.7 |
| 13. ZP_05335917.1 | 33.8 | 36.4 | 38.7 | 35.5 | 35.3 | 35.2 | 32.5 | 28.8 | 35.1 | 37.6 | 47.8 | 47.8 | | 22.3 | 22.6 |
| 14. NP_624155.1 | 40.2 | 40.3 | 37.2 | 41.1 | 41.4 | 39.4 | 37.8 | 33.5 | 43.3 | 44.6 | 48.4 | 48.4 | 40.6 | | 97.6 |
| 15. ZP_05091540.1 | 40.2 | 40.8 | 36.9 | 40.1 | 41.1 | 39.3 | 37.6 | 33.5 | 43.5 | 44.4 | 49.1 | 49.4 | 40.4 | 98.6 | |

Example 4

Identification of Domains Comprised in Polypeptide Sequences Useful in Performing the Methods of the Invention 1. SGT1 Polypeptides The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 2 are presented in Table C1.

TABLE C1

Sequence search results

Show the detailed description of the results page
We found 6 Pfam-A matches to your search sequence (3 significant and 3 insignificant).
You did not choose to search for Pfam-B matches on your sequence:

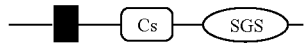

Show the search options and sequence that you submitted.
Return to the search form to look for Pfam domains on a new sequence.
Significant Pfam-A Matches
Show or hide all alignments

| Pfam-A | Description | Entry type | Sequence Start | End | HMM From | To | Bit score | E-value | Alignment method |
|---|---|---|---|---|---|---|---|---|---|
| TPR_1 | Tetratricopeptide repeat | Repeat | 70 | 103 | 1 | 34 | 21.0 | 7.3e-05 | fs |

```
#HMM    *->aeayynlGnaylklgkydeAieayekALeldPnn<-*
#MATCH     ++ay ++G+a++kl++y+ A +a+e     +l P
#SEQ       SKAYLRKGLACMKLEEYQTAKQQLETGASLAPGE 103
```

| CS | CS domain | Domain | 172 | 248 | 1 | | 83 | 94.3 | 7.3e-05 fs |
|---|---|---|---|---|---|---|---|---|---|

```
#HMM    *->prydWyQtldeVtitiplkgvfpikkkdvkVeilprslkvsikqpgggkpylldgepLfgp
#MATCH      r+++yQ ++eV++ti++kg+    ++k+v+V+++++ l+vsi +pgg + y ++   Lfg+
#SEQ       YRHEFYQKPEEVVVTIFAKGI---PAKNVVVDFGEQILSVSIDLPGG-ETYSFQPR-LFGK

#HMM       IdpeeSswkiedtkkveItLkK<-*
#MATCH     I p ++ + +++t k+eI L K
#SEQ       ITPAKCRYEVMST-KIEIRLAK  248
```

| SGS | SGS domain | Domain | 287 | 368 | 1 | | 91 | 168.1 | 9.9e-53 ls |
|---|---|---|---|---|---|---|---|---|---|

```
#HMM    *->kKnWDkLtaveKrlkevkKEekisedEkldGeAALnnlFKklYeDgDddmkRAMmKSftES
#MATCH       +WDkL+a      +vkKEek   dEkldG+AALn++F+++Y+D+D+d++RAMmKSf+ES
#SEQ        NVDWDKLEA------QVKKEEK---DEKLDGDAALNKFFRDIYKDADEDTRRAMMKSFVES
```

TABLE C1-continued

Sequence search results

```
#HMM      nGTvLSTNWkdVgkkkVetkPpeGmEpKew<-*
#MATCH    nGTvLSTNWk Vg kkVe++Pp+GmE+K+w
#SEQ      NGTVLSTNWKKVGTKKVEGSPPDGMELKKW
```

2. CLC-pKG Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the pfam scan of the polypeptide sequence as represented by SEQ ID NO: 54 are presented in Table C2.

TABLE C2 pfam scan results (major accession numbers) of the polypeptide sequence as represented by SEQ ID NO: 54.

| Database | Accession number | Accession name | Amino acid coordinates on SEQ ID NO 54 |
|---|---|---|---|
| Pfam | PF00571 | Voltage Gate Chloride Channel | 77-422 |
| Pfam | PF00571 | CBS domain | 455-510 |
| Pfam | PF00571 | CBS domain | 516-571 |
| Pfam | PF00582 | Universal Stress Protein Family | 597-731 |

3. HD-Hydrolase-Like Polypeptides

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence as represented by SEQ ID NO: 119 are presented in Table C3.

TABLE C3

InterPro scan results (major accession numbers) of the polypeptide sequence as represented by SEQ ID NO: 119.

| Database | Accession number | Accession name | Amino acid coordinates on SEQ ID NO 119 |
|---|---|---|---|
| InterPro | IPR013407 | CRISPR-associated protein Crm2 | |

TABLE C3-continued

InterPro scan results (major accession numbers) of the polypeptide sequence as represented by SEQ ID NO: 119.

| Database | Accession number | Accession name | Amino acid coordinates on SEQ ID NO 119 |
|---|---|---|---|
| HMMTigr | TIGR02577 | cas_TM1794_Crm2: CRISPR-associated pr | [221-842] 8.7e-13 |

Example 5

Topology Prediction of the Polypeptide Sequences Useful in Performing the Methods of the Invention 1. SGT1 Polypeptides TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters are selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:

ChloroP 1.1 hosted on the server of the Technical University of Denmark;

Protein Prowler Subcellular Localisation Predictor version 1.2 hosted on the server of the Institute for Molecular Bioscience, University of Queensland, Brisbane, Australia;

PENCE Proteome Analyst PA-GOSUB 2.5 hosted on the server of the University of Alberta, Edmonton, Alberta, Canada;

TMHMM, hosted on the server of the Technical University of Denmark

PSORT (URL: psort.org)

PLOC (Park and Kanehisa, Bioinformatics, 19, 1656-1663, 2003).

2. CLC-pKG Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

In addition or alternatively, many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

3. HD-Hydrolase-Like Polypeptides

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

The results of TargetP 1.1 analysis of the polypeptide sequence as represented by SEQ ID NO: 119 are presented Table D1. The "plant" organism group has been selected, no cutoffs defined, and the predicted length of the transit peptide requested. The subcellular localization of the polypeptide sequence as represented by SEQ ID NO: 119 may be the cytoplasm or nucleus, no transit peptide is predicted.

TABLE D1

TargetP 1.1 analysis of the polypeptide sequence as represented by SEQ ID NO: 119. Abbreviations: Len, Length; cTP, Chloroplastic transit peptide; mTP, Mitochondrial transit peptide; SP, Secretory pathway signal peptide; other, Other subcellular targeting; Loc, Predicted Location; RC, Reliability class; TPlen, Predicted transit peptide length.

| Name | Len | cTP | mTP | SP | other | Loc | RC | TPlen |
|---|---|---|---|---|---|---|---|---|
| SEQ ID NO: 119 | 979 | 0.103 | 0.321 | 0.050 | 0.554 | — | 4 | — |
| cutoff | | 0.000 | 0.000 | 0.000 | 0.000 | | | |

Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

Example 6

Assay Related to the Polypeptide Sequences Useful in Performing the Methods of the Invention 1. CLC-pKG Polypeptides Marmagne et al 2007 described a method functionally complements the gef-1 yeast mutant. In brief, suspensions of the indicated strains W303 (WT), RGY86 (gef-1 mutant) and each transformant (gef-1:CLC-of interest) are set up at DO1 (53108 cells). Serial dilutions (d1-d16) are spotted onto the appropriate media. For the low-iron phenotype, a 4-folddilution of each suspension may be spotted onto YPEG media supplemented with 0.6 mM ferrozine, pH 5.8 (A, B) and grown for 3 d at 30 _C. For the pH-dependent phenotype, an 8-fold dilution is spotted onto YPD (C), SD 6 0.1 mM CuSO4, pH 7 (D, E) and SGE 6 CuSO4 0.1 mM, pH7 (F, G) media and is grown for 3 d at 30 _C.

In addition or alternatively the patch clamp based method described by De Angeli (Nature 442, 939-942, 2006) may be used to measure currents across the tonoplast. The patch clamp technique is well known in the art for studying ion channel activity in cells, see for example Hamill et al., Pflügers Archiv (European Journal of Physiology) 391, 85-100, 1981.

Example 7

Cloning of the Nucleic Acid Sequence Used in the Methods of the Invention

1. SGT1 Polypeptides

The nucleic acid sequence was amplified by PCR using as template a *Capsicum annuum* cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm14133 (SEQ ID NO: 51; sense, start codon in bold): 5'-aaaaa gcaggctcacaatggagaatgggaaaagagac-3' and prm14134 (SEQ ID NO: 52; reverse, complementary): 5'-agaaagctgggttggttttaactagttccaccg-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pSGT1. Plasmid pDONR201 was purchased from Invitrogen, as part of the Gateway® technology.

The entry clone comprising SEQ ID NO: 1 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice RCc3 promoter (SEQ ID NO: 50) for root-specific expression was located upstream of this Gateway cassette.

After the LR recombination step, the resulting expression vector pRCc3::SGT1 (FIG. 4) was transformed into *Agrobacterium* strain LBA4044 according to methods well known in the art.

2. CLC-pKG Polypeptides

The nucleic acid sequence was amplified by PCR using as template a custom-made Synechosystis DNA. PCR was performed using Hifi Taq DNA polymerase in standard conditions, using 200 ng of template in a 50 µl PCR mix. The primers used were: 5'-ggggacaagtttgtacaaaaaagcag-gcttaaacaatggcttggtttcccttt-3' (SEQ ID NO: 116) and 5'-ggg-gaccactttgtacaagaaagctgggtttactcgtctagaccgaaatctg-3' (SEQ ID NO: 117), which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pCLC-pKG. Plasmid pDONR201 was purchased from Invitrogen, as part of the Gateway® technology.

The entry clone comprising the longest Open Reading Frame of SEQ ID NO: 53 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice RCc3 promoter (SEQ ID NO: 115) for root specific expression was located upstream of this Gateway cassette.

After the LR recombination step, the resulting expression vector pGOS2::CLC-pKG (FIG. 7) was transformed into *Agrobacterium* strain LBA4044 according to methods well known in the art.

3. HD-Hydrolase-Like Polypeptides

The nucleic acid sequence was amplified by PCR using as template a custom-made *Synechocystis* cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm14240 (SEQ ID NO: 165; sense, start codon in bold): 5'-ggggacaagtttgtacaaaaaagcag-gcttaaacaatgtctgaagtttactggcaag-3' and prm14239 (SEQ ID NO: 166; reverse, complementary): 5'-ggggaccactttgtacaa-gaaagctgggtttaattgggaa atttaatgtaacg-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pHD-hydrolase-like. Plasmid pDONR201 was purchased from Invitrogen, as part of the Gateway® technology.

The entry clone comprising SEQ ID NO: 118 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 164) for constitutive specific expression was located upstream of this Gateway cassette.

After the LR recombination step, the resulting expression vector pGOS2::HD-hydrolase-like (FIG. 11) was transformed into *Agrobacterium* strain LBA4044 according to methods well known in the art.

Example 8

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Example 9

Transformation of Other Crops

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by lshida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin, (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 µm J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 µm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 µg/ml cefotaxime. The seeds are then transferred to SHmedium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 10

Phenotypic Evaluation Procedure 10.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions were watered at regular intervals to ensure that water and nutrients were not limiting and to satisfy plant needs to complete growth and development.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

10.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

Where two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment-event-segregants). P values were obtained by comparing likelihood ratio test to chi square distributions.

10.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Examples 11

Results of the Phenotypic Evaluation of the Transgenic Plants

1. SGT1 Polypeptides

The results of the evaluation of transgenic rice plants in the T2 generation and expressing a nucleic acid comprising the longest Open Reading Frame in SEQ ID NO: 1 under non-stress conditions are presented below.

| Parameter | % Overall |
| --- | --- |
| Total weight seeds | 10.5 |
| Fill rate | 10.6 |
| Harvest index | 10.0 |
| Number filled seeds | 11.3 |
| Number of Flowers per.panicle | 6.6 |

For each parameter, the percentage overall difference between transgenic and control plants (corresponding nullizygotes) is shown if value reaches p<0.05 and above the 5% threshold.

2. CLC-pKG Polypeptides

The results of the evaluation of transgenic rice plants in the T1 generation and expressing a nucleic acid comprising the Open Reading Frame in SEQ ID NO: 53 encoding the polypeptide of SEQ ID NO: 54 under non-stress conditions are presented below. See previous Examples for details on the generations of the transgenic plants.

The results of the evaluation of transgenic rice plants under non-stress conditions are presented below. An increase of at least 5% was observed for aboveground biomass (AreaMax), plant height (HeightMax), emergence vigour (early vigour; EmerVigor), root biomass (RootMax), total seed yield (totalwgseeds), harvest index (harvestindex), Proportion of thick roots compared to thin roots (RootThickMax), Gravity center of the canopy of the plants (GravityYMax). The last two parameters are indicative of a change in the architecture of the root system and of the canopy of the plant, respectively.

TABLE E1

Data summary for transgenic rice plants; for each yield-related trait, the overall percent increase is shown for the T1 generation, for each parameter the p-value is <0.05.

| Yield related trait | % increase in the transgenic compared to the control plants |
| --- | --- |
| AreaMax | 10.6 |
| EmerVigor | 6.0 |
| RootMax | 11.1 |
| totalwgseeds | 17.4 |
| harvestindex | 9.3 |
| HeightMax | 5.7 |
| GravityYMax | 7.3 |
| RootThickMax | 7.8 |

3. HD-Hydrolase-Like Polypeptides

The results of the evaluation of transgenic T1 rice plants and expressing a nucleic acid encoding the polypeptide of SEQ ID NO: 119 under non-stress conditions are presented below in Table E2.

TABLE E2

Data summary for transgenic rice plants; for each parameter, the overall percent increase is shown for the confirmation (T1 generation), for each parameter the p-value is <0.05.

| Parameter | Overall increase |
| --- | --- |
| totalwgseeds | 15.4 |
| fillrate | 12.7 |
| harvestindex | 14.1 |
| flowerperpan | 9.2 |
| Height | 7.0 |

SEQUENCE LISTING (173 sequences)

SEQ ID NO: 1 - DNA, 1341 bp, Capsicum annuum
cgttgcacaaattgatgagcaatgcttttttataatgccaactttgtacaaaaaagcaggcttaaacaatggcgtccgatcttgaaactagggctaaagaagccttcattgatgaccactttgaactcgccgttgacctttatactcaagccatatcgttgagccctaaaaaccctgagcttttcgctgaccgtgctcaggccaatattaaactcaattatttcactgaagctgttgttgatgcgaacaaggccattgagttggatccttacatgtcaaaagcttatttgcgtaaggggttggcctgtatgaagctcgaagaataccaaactgcgaaggcagctttggaaactggtgctagtttagcaccaggagagtctaggttcacaaagctaatgaaagaatgtgatgaaagcattgcagaggaagctggagaactgcctaatatctctctggaaaaaacctcggctaatgctgttgcgtcttctgcatctgagttgtcggacaatgttgctattgcgcctagagatcctcaatcaactgtcaacctgtcccatcaagaatctgctgccaaaccaaaatacagacatgagttttatcagaaaccagaggaggtggttgtgactatatttgccaagggcataccagccaagaatgttgttgttgactttggtgaacaaatactaagtgttagcattgatttgccgggtggagaaacttattctttccagcctaggttgtttggcaagataacacctgcaaaatgcagatatgaagtaatgtctaccaaaattgagatccgccttgcaaaagctgaaccattgcactggacatctcttgattatacaagggagcctgtcgtaattcacaggcctgttgtgtcatcagctgccccgcggcccagttacccttcctcaaaactgagaaacgtggattgggataaactagaagctcaagtgaaaaaagaggaaaaagatgaaaaattggatggagatgctgcattgaacaaatttttccgagacatttacaaagatgctgacgaggacaccagaagagccatgatgaaatcctttgtggaatctaatgggactgttctgtcgacaaactggaaaaaagttggcacaaagaaggttgaaggaagccctccggatggcatggagttgaagaaatgggagatttagagtcaatctgctgtttatcttttgtgacccagctttcttgtacaaagttggcattataagaaagcattgcttatcaatttgttgcaacgaacaggtcactatcggtcaaaataaaatcattatttgccatccagctgatattcccctatagtgagtcgta

SEQ ID NO: 2 - protein, 370 aa, Capsicum annuum
MASDLETRAKEAFIDDHFELAVDLYTQAISLSPKNPELFADRAQANIKLNYFTEAVVDANKAIELDPYMSKAYLRKGLACMKLEEYQTAKAALETGASLAPGESRFTKLMKECDESIAEEAGELPNISLEKTSANAVASSASELSDNVAIAPRDPQSTVNLSHQESAAKPKYRHEFYQKPEEVVVTIFAKGIPAKNVVVDFGEQILSVSIDLPGGETYSFQPRLFGKITPAKCRYEVMSTKIEIRLAKAEPLHWTSLDYTREPVVIHRPVVSSAAPRPSYPSSKLRNVDWDKLEAQVKKEEKDEKLDGDAALNKFFRDIYKDADEDTRRAMMKSFVESNGTVLSTNWKKVGTKKVEGSPPDGMELKKWEI

SEQ ID NO: 3 - DNA, 1387 bp, Arabidopsis thaliana
aactccctgaacacaagtcgcataaaacgaaggaacaatctagaagaagaacgataacatccaatctctctttatattccttccttccattgtggcaataatcaatcgatggcgaaggagcttgctgataaggctaaagaggctttcgtagacgatgacttcgatgttgctgttgacttgtactccaaagccattgacttggatcctaattgcgctgagttcttcgctgatcgtgctcaggcctatatcaaactcgaaagcttcactgaggccgtggcagatgcgaacaaagcaattgagttggatccttcattgaccaaagcttacctaagaaaaggaactgcctgtatgaagcttgaagagtatcggactgctaaaacagctcttgaaaagggtgcctctatcacgccgagtgaatccaaatttaagaagttgatagatgaatgcaattttctaatcacagaagaagagaaagatttggttcaaccggtgccttcgactttgccttcaagtgtgacagcaccaccagtatctgaacttgatgtcacccctacagccaagtacaggcacgagtactaccaaaagccagaggaagttgtggtaactgtttttgcaaaaggaatacccaagcagaatgttaacatcgactttggtgaacaaattctgagtgttgtgattgaggttcctggagaggatgcgtattatctccaaccgagattgtttggaaagataataccagataagtgcaaatatgaagtattgtcgaccaaaattgagatctgtcttgcaaaagccgatataatcacatgggcctccctcgaacacggcaaagggccagcggttttgccaaagcctaatgtctcatcagaggtttcacagaggccagcttatccatcttctaagaaagttaaggactgggacaagctggaagctgaagtgaagaagcaggaaaaagatgagaagctggaaggagacgcagctttgaacaaattcttccgggagatataccagaatgcggatgaggatatgaggcgagcgatgagcaaatcatttgtggaatcgaatgggacagtgctgtcaacaaactggcaagaggttgggactaagacaatcgagagtactcctccggatggcatggagctcaagaaatgggagatctgatctgatatgatatgatgatcctttcctttttatgcagttgtgaattttgcctaaatgtagacaaatcttgaaacctggtccctttcttcctgtaatgaggatcctaaggtttttgcttttttgttaaatatggctttctacctctgctatgttgtgacttgtgagttatattgtctttaggtctcaacttttttgtttttgtttttatttgagtattcataatttc

SEQ ID NO: 4 - protein, 350 aa, Arabidopsis thaliana
MAKELADKAKEAFVDDDFDVAVDLYSKAIDLDPNCAEFFADRAQAYIKLESFTEAVADANKAIELDPSLTKAYLRKGTACMKLEEYRTAKTALEKGASITPSESKFKKLIDECNFLITEEEKDLVQPVPSTLPSSVTAPPVSELDVTPTAKYRHEYYQKPEEVVVTVFAKGIPKQNVNIDFGEQILSVVIEVPGEDAYYLQPRLFGKIIPDKCKYEVLSTKIEICLAKADIITWASLEHGKGPAVLPKPNVSSEVSQRPAYPSSKKVKDWDKLEAEVKKQEKDEKLEGDAALNKFFREIYQNADEDMRRAMSKSFVESNGTVLSTNWQEVGTKTIESTPPDGMELKKWEI

SEQ ID NO: 5 - DNA, 1416 bp, Arabidopsis thaliana
aacatccaatctctctttatattccttccttccattgtggcaataagtaacaaaccttgccctctacttcattccctccttgttttgatttcatcgtctttgttagctctcctctgtttttttttcttagtcaatcgatggcgaaggagcttgctgataaggctaaagaggctttcgtagacgatgacttcgatgttgctgttgacttgtactccaaagccattgacttggatcctaattgcgctgagttcttcgctgatcgtgctcaggcctatatcaaactcgaaagcttcactgaggccgtggcagatgcgaacaaagcaattgagttggatccttcattgaccaaagcttacctaagaaaaggaactgcctgtatgaagcttgaagagtatcggactgctaaaacagctcttgaaaagggtgcctctatcacgccgagtgaatccaaatttaagaagttgatagatgaatgcaattttctaatcacagaagaagagaaagatttggttcaaccggtgccttcgactttgccttcaagtgtgacagcaccaccagtatctgaacttgatgtcacccctacagccaagtacaggcacgagtactaccaaaagccagaggaagttgtggtaactgtttttgcaaaaggaatacccaagcagaatgttaacatcgactttggtgaacaaattctgagtgttgtgattgaggttcctggagaggatgcgtattatctccaaccgagattgtttggaaagataataccagataagtgcaaatatgaagtattgtcgaccaaaattgagatctgtcttgcaaaagccgatataatcacatgggcctccctcgaacacggcaaagggccagcggttttgccaaagcctaatgtctcatcagaggtttcacagaggccagcttatccatcttctaagaaagttaaggactgggacaagctggaagctgaagtgaagaagcaggaaaaagatgagaagctggaaggagacgcagctttgaacaaattcttccgggagatataccagaatgcggatgaggatatgaggcgagcgatgagcaaatcatttgtggaatcgaatgggacagtgctgtcaacaaactggcaagaggttgggactaagacaatcgagagtactcctccggatggcatggagctcaagaaatgggagatctgatctgatatgatatgatgatcctttcctttttatgcagttgtgaattttgcctaaatgtagacaaatcttgaaacctggtccctttcttcctgtaatgaggatcctaaggtttttgcttttttgttaaatatggctttctacctctgctatgttgtgacttgtgagttatattgtctttaggtctcaacttttttgtttttgtttttatttgagtattcataatttc

SEQ ID NO: 6 - protein, 350 aa, Arabidopsis thaliana; identical to SEQ ID NO: 4

SEQ ID NO: 7 - DNA, 1456 bp, Arabidopsis thaliana
aaaacgttcttaaaagaaaaaaaaaatcccaaacacagcaaaaaaaaaaaaagcctagaggaatagaatcggtctctttctctataatctctctctctctctgacttgtttgtgttctctcaaatcctctgataagaatcaatggccaaggaattagcagagaaagctaaagaagcttttctagatgatgacttcgatgttgctgttgacttatactccaaagccattgacttggatcccaattgcgccgccttcttcgccgatcgtgctcaggccaacatcaaaatcgataacttcactgaagctgttgtagatgcgaacaaagccattgagttggagccaacgttggcaaaagcctatctcagaaagggcactgcttgtatgaagctagaagaatatagtactgctaaagcagccctggaaaagggagcttctgttgcaccgaatgaaccaaagtttaagaagatgatagatgaatgcgatcttcgtattgcagaagaagagaaagatttggttcagccgatgccaccgagtttgccttcaagctctacaacaccactagcaacggaagctgatgctcctcctgttccaattcctgcagcacctgccaaaccgatgttcaggcacgagttctaccagaaaccagaagaagcggtggtgacaattttcgccaaaaaagtacctaaggagaacgtaactgtcgagtttggtgagcagattctgagtgttgtcattgatgttgctggagaggaagcttatcatctccagccgagattgttcgggaagataataccagagaagtgcagatttgaagtattgtcgaccaaagttgagatccgtcttgcgaaagcagagataatcacctgggcctcccttgaatatggtaaagggcaaagtgttttgcccaaacccaatgtctcatcagcgctgtcgcagagaccagtgtacccatcttctaagccagcaaaagactgggacaagttggaagctgaagtgaagaaacaggagaaggatgagaagcttgatggagatgcagctatgaacaaatttttcagcgacatatactcgagtgcagatgaagacatgaggcgggcaatgaacaaatcatttgcagagtcgaatgggacggtactgtcgacaaactggaaagaagttgggactaagaaagtggagagcactccaccagatggcatggagctcaagaagtgggagtattgatcttcttaaaatccccttttctggtttttgttaaaaaaaagtctgacaaatcttttgaacttttaaggtgtttttcttttttggtttctgctcgaatttgtctctctccattcttgcgttgtggtctcaaagaacgttctgatactttgattttgtattagaaaactaaaactcgcaagtctgttgttttggaactttgttcttttatcgagaggcttatctaaatatttcttgacat

SEQ ID NO: 8 - protein, 358 aa, Arabidopsis thaliana
MAKELAEKAKEAFLDDDFDVAVDLYSKAIDLDPNCAAFFADRAQANIKIDNFTEAVVDANKAIELEPTLAKAYLRKGTACMKLEEYSTAKAALEKGASVAPNEPKFKKMIDECDLRIAEEEKDLVQPMPPSLPSSSTTPLATEADAPPVPIPAAPAKPMFRHEFYQKPEEAVVTIFAKKVPKENVTVEFGEQILSVVIDVAGEEAYHLQPRLFGKIIPEKCRFEVLSTKVEIRLAKAEIITWASLEYGKGQSVLPKPNVSSALSQRPVYPSSKPAKDWDKLEAEVKKQEKDEKLDGDAAMNKFFSDIYSSADEDMRRAMNKSFAESNGTVLSTNWKEVGTKKVESTPPDGMELKKWEY

SEQ ID NO: 9 - DNA, 1334 bp, Arabidopsis thaliana
tgatttcatcgtctttgttagctctcctctgtttttttttcttagtcaatcgatggcgaaggagcttgctgataaggctaaagaggctttcgtagacgatgacttcgatgttgctgttgacttgtactccaaagccattgacttggatcctaattgcgctgagttcttcgctgatcgtgctcaggcctatatcaaactcgaaagcttcactgcagaggccgtggcagatgcgaacaaagcaattgagttggatccttcattgaccaaagcttacctaagaaaaggaactgcctgtatgaagcttgaagagtatcggactgctaaaacagctcttgaaaagggtgcctctatcacgccgagtgaatccaaatttaagaagttgatagatgaatgcaattttctaatcacagaagaagagaaagatttggttcaaccggtgccttcgactttgccttcaagtgtgacagcaccaccagtatctgaacttgatgtcacccctacagccaagtacaggcacgagtactaccaaaagccagaggaagttgtggtaactgtttttgcaaaaggaatacccaagcagaatgttaacatcgactttggtgaacaaattctgagtgttgtgattgaggttcctggagaggatgcgtattatctccaaccgagattgtttggaaagataataccagataagtgcaaatatgaagtattgtcgaccaaaattgagatctgtcttgcaaaagccgatataatcacatgggcctccctcgaacacggcaaagggccagcggttttgccaaagcctaatgtctcatcagaggtttcacagaggccagcttatccatcttctaagaaagttaaggactgggacaagctggaagctgaagtgaagaagcaggaaaaagatgagaagctggaaggagacgcagctttgaacaaattcttccgggagatataccagaatgcggatgaggatatgaggcgagcgatgagcaaatcatttgtggaatcgaatgggacagtgctgtcaacaaactggcaagaggttgggactaagacaatcgagagtactcctccggatggcatggagctcaagaaatgggagatctgatctgatatgatatgatgatcctttcctttttatgcagttgtgaattttgcctaaatgtagacaaatcttgaaacctggtccctttcttcctgtaatgaggatcctaaggtttttgcttttttgttaaatatggctttctacctctgctatgttgtgacttgtgagttatattgtctttaggtctcaacttttttgtttttgtttttatttgagtattcataatttc

SEQ ID NO: 10 - protein, 351 aa, Arabidopsis thaliana
MAKELADKAKEAFVDDDFDVAVDLYSKAIDLDPNCAEFFADRAQAYIKLESFTAEAVADANKAIELDPSLTKAYLRKGTACMKLEEYRTAKTALEKGASITPSESKFKKLIDECNFLITEEEKDLVQPVPSTLPSSVTAPPVSELDVTPTAKYRHEYYQKPEEVVVTVFAKGIPKQNVNIDFGEQILSVVIEVPGEDAYYLQPRLFGKIIPDKCKYEVLSTKIEICLAKADIITWASLEHGKGPAVLPKPNVSSEVSQRPAYPSSKKVKDWDKLEAEVKKQEKDEKLEGDAALNKFFREIYQNADEDMRRAMSKSFVESNGTVLSTNWQEVGTKTIESTPPDGMELKKWEI

SEQ ID NO: 11 - DNA, 1284 bp, Brassica napus
caaatcctcaaaaagagtgattcaatggcgaaggaactggcggaaaaagctaaagaggcgttcttagatgacgacttcgatgtggctgttgacttatactccaaagccattgacttggatccctcttgcgcctccttcttcgccgatcgtgctcaggccaacatcaaactccttaacttcaccgaagctgttgcagatgccaacaaagccatcgagttggagcctactttggccaaagcttatctcagaaagggcactgcttgtatgaagctagaagagtatgctactgctaaagcagctcttgagaagggcgcttccgttgcacctaatgaatccaagtttgagaagatgatagatgaatgcaaccttctcattgcagaagaagagaaagatttggttcaacaggtgccaccgactttgccttcaagctctacaacaccactagcaatcgcagctgatgctcctcctgttccaagtcctgcaccacctgccaaacctatgttcaggcacgagttctaccagaagccagaggaggttgtggtgacaattttcgctaaaggaataccaaagcagaacgtgaatgtagagtttggtgaccagattctgagtgttgtgattgatgttgctggagaagaagcttatcatttccagccaagattgttcgggaagataataccagagaagtgcaggtatgaggtattgtcaaccaaagttgagatccgtctcgcaaaagcagagatagtcacttgggcctcccttgaatatggcaaagggcaagctcttctgcctaaacccaatgttgcatcagcagtgtctcagaggccggtgtacccatcctctaagccgggaaaagactgggacaagctggaagctgaagtgaagaaacaggagaaggatgagaagctagatggagatgcagctatgaacaagtttttcagcgacatataccagagtgcagatgaggacatgaggcgagccatgaacaaatcatttgcagagtcaaatgggacggtgctgtctacgaactggaaagaggttgggacaaagaaagtggagagcactccaccagatggcatggagctgaagaagtgggagtattgatgatctttttaaatccttttatctggtcttttcaaaaatctctgacaaatctttaaagttccattggtttttcaagtttgggtctgagaaaacgagtgtgctagaaaaccgcgcaagtttgtgctttgtaccttttcttctccctcgagagagggcttcgaatgacattcttgcattgttatc

SEQ ID NO: 12 - protein, 358 aa, Brassica napus
MAKELAEKAKEAFLDDDFDVAVDLYSKAIDLDPSCASFFADRAQANIKLLNFTEAVADANKAIELEPTLAKAYLRKGTACMKLEEYATAKAALEKGASVAPNESKFEKMIDECNLLIAEEEKDLVQQVPPTLPSSSTTPLAIAADAPPVPSPAPPAKPMFRHEFYQKPEEVVVTIFAKGIPKQNVNVEFGDQILSVVIDVAGEEAYHFQPRLFGKIIPEKCRYEVLSTKVEIRLAKAEIVTWASLEYGKGQALLPKPNVASAVSQRPVYPSSKPGKDWDKLEAEVKKQEKDEKLDGDAAMNKFFSDIYQSADEDMRRAMNKSFAESNGTVLSTNWKEVGTKKVESTPPDGMELKKWEY

SEQ ID NO: 13 - DNA, 1458 bp, Glycine max
gaattcggcaccagatcattcattcctattccttctttctcttccaattccaaatcacaacccttcgttttccctctctagaatcttcttctccattcaattcctactccttttttcctctctgtccctctctctctccctctctcatggcttccgatctcgaagcaaaagccaaagaggccttcgtcgaagaccacttcgaactcgccgtggaccttctctctcaggccattcatctcgaacccaacaaagccgaattctacgccgaccgcgcccaagccaacatcaaactcaacaacttcactgaggctgtggctgatgctaacaaagcaattgaattgaatccttctctaccaaaagcatatttgcggaaaggtactgcttgcatgaagcttgaggaatatgaaactgcaaaggctgctctggaggtgggtgcatcattgtctccagacaactcaaggtttgctactttgatcaaagaatgtgataagctcattgcagaagaatcttataccccacctattatagaggaaaagaccacaacagaggatgctactccaaaagatgttcagcaacaagatgatcttctagagaagccaacagttacagtgactaaacctaaatataggcatgaattctaccagaaacatgatcagttggttgtgaccatatttgcaaagaaaatcccaaaggaaagcattactgttgacttcggtgaacaaatactaagtgttagtattaatgtccctggagaagacacatatgcttttcaacctcgcttatttggaaagatcataccttccaattgccaatatgaagttttgtccaccaaaattgaaattcgtcttgcaaaagcagaacctattcactggacatctctagaattcaccagagacatcgttgttcaacagagggttaatgcttcttcagttactggaagtcaaagaccttcttacccatcctcaaaacaaacaagagattgggacaagattgaagctcaagtcaagaaagaggagaaagatgaaaagcttgatggcgatgctgcgttgaacaaatttttccgtgaaatatatcaagatgcagatgaggatacaaggagggcaatgaaaaagtcttttgttgagtctaatgggacagtgctgtctacaaactggaaagaagtgggatcaaagaaggtagagggaagtgctcctgatggcatggagttgaagaaatgggaatattaagacattttctggatcaatgttatacatattttggtgtgagattatactttggtttgtttttgttggttagcttaactgctgaactaaagatacttattttctttaattttttatttattttcatgaggtgtgtccgtcttcgctaggacctgaattcatggttgttggttgagaggacaaggctgttgtctttggtgaatatattgcaactttctgttgtaaaaaaaaaaaa

SEQ ID NO: 14 - protein, 359 aa, Glycine max
MASDLEAKAKEAFVEDHFELAVDLLSQAIHLEPNKAEFYADRAQANIKLNNFTEAVADANKAIELNPSLPKAYLRKGTACMKLEEYETAKAALEVGASLSPDNSRFATLIKECDKLIAEESYTPPIIEEKTTTEDATPKDVQQQDDLLEKPTVTVTKPKYRHEFYQKHDQLVVTIFAKKIPKESITVDFGEQILSVSINVPGEDTYAFQPRLFGKIIPSNCQYEVLSTKIEIRLAKAEPIHWTSLEFTRDIVVQQRVNASSVTGSQRPSYPSSKQTRDWDKIEAQVKKEEKDEKLDGDAALNKFFREIYQDADEDTRRAMKKSFVESNGTVLSTNWKEVGSKKVEGSAPDGMELKKWEY

SEQ ID NO: 15 - DNA, 2351 bp, Hordeum vulgare
atttcggtacgaggcaggatttgtcctcctccacccagccgccaagccttctcgaagcttccccggcccgcccccgatccgatcggaccgcctgccatggccgacgaggcgaaggccaaaggtaatgcggccttctcggccggccgcttcgaggaggcggcggggcacttctccgacgccatcgcgctcgccccggccaaccacgtgctctactccaaccgctcggcggcgctcgcctcgatccaccgctactccgacgcgctcgccgacgccgagaagaccgtcgagctcaagcccgactgggccaagggctactcgcgcctcggcgccgcacacctcggcctcggcgacgcggccagcgccgccgccgcctacgagaagggcctcgccctcgatcccagcaacgagggcctcaaggccggcctcgctgacgccaagaaggctgcggccgccccgccgcggcgcccgccttctggcggcgccgacgcgatcggccagatgttccagggccccgagctctggaccaagatcgcttccgaccccgctacgcgcgcctacctcgaccagccggatttcatgcagatgctgcgggacgtgcagcgggatcccagcagtctcaacatgttcctatccgacccgcgcatgatgcaggtgctcagcctcatgcttaacatcaagatccagacgccccaggactccgattttccgcagtcctcctcgccgtcgcagccaccaccgcagcagcagaggcaacagcccgagacaaaggcgagggagatggagcctgagccacagccggagcccatggaggtgtctgatgaggacaaggagaagaaggagaggaaagctgctgctctgaaggagaaggaggcagggaatgcatcgtacaagaagaaggacttcgagacggcgatccagcattacacaaaggccatggaacttgatgacgaggacatctcctacctcactaaccgagcagcggtgtacatcgaaatggggaagtttgatgagtgcattgcggactgtgataaagctgtggagaggggaagggaacttcgtgctgatttcaagatggttgctagggcactaacaagaaaaggaactgctctggccaaacttgctaagaactccaaggactatgatattgccattgagactttccagaaggctctaactgagcaccggaatccagacactcttaaaaggttaaatgaggctgagaaggcaaagaaagatttggagcaacaagagtattatgacccaaagatagctgatgaggagagggagaaaggtaatgagatgttcaagcagcagaagtatccagaagcaataaagcattacaatgaggctatcaggaggaacccgaaggatgctagggtatacagcaatagagctgcatgctataccaagctgggagccatgcctgaaggtcttaaagacgcagagaagtgtattgagctagacccaaccttctccaaagggtatacaaggaagggtgcagttcagttttttatgaaggaatatgagaaggcaatggaaacttaccaggctgggttaaagcttgaccctaataaccaggaactgcttgatggcataaggaggtgtgttcagcagatcaacaaggctaacaggggtgacataagtcaggaggatttgcaggagaaacagagtaaagctatgcaggacccagaaatccagaacatccttaccgatcctatcatgcgacaggtgttgatggatttccaggagaaccctagggctgctcaggatcatctgaaggaccctggagtggcacagaagatccaaaagctcataaacgctggaatagtccaaacgagatgatcaagcaagggcgtttgtgttgagattgtgctcggttgtgtcgtcactgtacactgcttctctgcccagcgtgaacttcttttgtatgccatggggcatccatttcagttggatttgtgagtacagcctgccacatcgttattcctgtgtacggctattatgttacagttctatgtgggcaatgtcccatatattattagttgtagccgttttcgccttcacagtggacaaacagatgctagaacaagaacagtagaatgttattgtattttatttcttgctgtgctagggaaatgctgtcaatggagaaaattcattgaaaaaaaaaaaaaaaaaaaaaattcaggggggggccccgggacccaatattgcctttaatggagtgggatttcaaattcatgggccggcgttttacaaacggggggattgggaaaaaccctgggcggtcccaaaatttatttgcttgtggaaaattaccccttttttccaatggggggtaaaagcaaaaa

SEQ ID NO: 16 - protein, 581 aa, Hordeum vulgare
MADEAKAKGNAAFSAGRFEEAAGHFSDAIALAPANHVLYSNRSAALASIHRYSDALADAEKTVELKPDWAKGYSRLGAAHLGLGDAASAAAAYEKGLALDPSNEGLKAGLADAKKAAAAPPRRPPSGGADAIGQMFQGPELWTKIASDPATRAYLDQPDFMQMLRDVQRDPSSLNMFLSDPRMMQVLSLMLNIKIQTPQDSDFPQSSSPSQPPPQQQRQQPETKAREMEPEPQPEPMEVSDEDKEKKERKAAALKEKEAGNASYKKKDFETAIQHYTKAMELDDEDISYLTNRAAVYIEMGKFDECIADCDKAVERGRELRADFKMVARALTRKGTALAKLAKNSKDYDIAIETFQKALTEHRNPDTLKRLNEAEKAKKDLEQQEYYDPKIADEEREKGNEMFKQQKYPEAIKHYNEAIRRNPKDARVYSNRAACYTKLGAMPEGLKDAEKCIELDPTFSKGYTRKGAVQFFMKEYEKAMETYQAGLKLDPNNQELLDGIRRCVQQINKANRGDISQEDLQEKQSKAMQDPEIQNILTDPIMRQVLMDFQENPRAAQDHLKDPGVAQKIQKLINAGIVQTR

SEQ ID NO: 17 - DNA, 1125 bp, Medicago vulgare
atggcgcaagaactcgaaaacaaagccaaagaagcttttttcgacgacgattttacactcgccgttgatttctattctcaagccatcgaaatcgatcccaccaacgctaatctctttgccgatcgagcacaatcgcatatcaaactcaacgctttcactgaagctgtttctgatgctaataaggctattcaattgaaccctaatttgtctaaagcttatcttcgcaaagggactgcttgtattaatcttgaagaatatcatactgctaaggttgcacttgaaaagggggcttcttttgcacctgatgattccagattcactaatttgattcaacaatgtcaacgcttcattgctgctgaggaatctgaaagtcttacgagcaccctaccaccaaatggacccaaatcatctgttgcgtctgttgatgatacccatatgtgtgataagagtgatgaaacatccaaagaacctcaaagagacagtcctgcatcccaaacaaatgcagttgcaccagtcagaccaaaatacaggcatgaatattaccagaagccagaagaagtggttgtgacaatatttgcaaaagggataccagcagaaaatgttgttgtggacttcggcgaacagattctgagtgttaccattgatgttcctggccaagatgcctaccattaccaacctagattgtttggaaagataatacctgataagtgcaaagttgtggttttgtcaaccaaaattgagattcgtctggcaaaagctgaagcagttaattggacatctctggaatatagcaaggatgtgcttccccaaaagataatcgtgccctcagttcaatctgaaaggcctgcatatccgtcatcaaagtcaaggactaaggattgggataagttggaagctgaagtgaaaaaagaggagaaagaagaaaagcttgatggtgatgctgctttgaataaattgttccgtgatatttaccaaaatgcagacgaggacatgaggagagcgatgagcaagtcttttctggagtcaaatggaacagtgctttcaactgattggaaagaagtgggatcaaagaaggtggaaggaagtcctccggaaggcatggaggtgaagaaatgggagtattga

SEQ ID NO: 18 - protein, 374 aa, Medicago vulgare
MAQELENKAKEAFFDDDFTLAVDFYSQAIEIDPTNANLFADRAQSHIKLNAFTEAVSDANKAIQLNPNLSKAYLRKGTACINLEEYHTAKVALEKGASFAPDDSRFTNLIQQCQRFIAAEESESLTSTLPPNGPKSSVASVDDTHMCDKSDETSKEPQRDSPASQTNAVAPVRPKYRHEYYQKPEEVVVTIFAKGIPAENVVVDFGEQILSVTIDVPGQDAYHYQPRLFGKIIPDKCKVVVLSTKIEIRLAKAEAVNWTSLEYSKDVLPQKIIVPSVQSERPAYPSSKSRTKDWDKLEAEVKKEEKEEKLDGDAALNKLFRDIYQNADEDMRRAMSKSFLESNGTVLSTDWKEVGSKKVEGSPPEGMEVKKWEY

SEQ ID NO: 19 - DNA, 1518 bp, Oryza sativa
ctacccctccgcgaagtcttcgtctggtcttcccccacccgcatcccccggcctcctcaccgcagccgcaaaagccaagccgccatggcaaccgccgccgcgtcggatctggagagcaaggccaaggcggccttcgtcgacgacgacttcgagctcgccgccgagctctacacgcaggcaatcgaggccagccccgccaccgccgagctctacgccgaccgcgcccaggcccatatcaagctaggcaactacactgaggctgtagctgatgctaacaaggccattgaacttgacccatcaatgcacaaggcttatcttcgtaaaggcgctgcatgtatacgactggaggagtatcaaactgcaaaagcagctcttgaattgggttactcgttcgcatctggtgactcaaggtttactcgcctaatgaaggagtgtgatgagcgcattgctgaggagcttagtgaagtccctgttaagaaggctgaagatggagcagctgccccctctgttgcttcttttgttgaggaaaaggatgatgctgcaaacatggataatacaccaccaatggtagaagtgaagccaaaatacaggcacgacttctacaacagtgctacagaagttgtattgacaatttttgcaaagggtgttcctgctgagaatgttgttgttgattttggtgaacaaatgttaagtgtgtcgattgaagtccctggagaggagccgtaccattttcagcctcgtctgttttctaagatcatccctgagaaaagcagataccaagtgctatccacgaaggttgaaataagactggctaaagctgaacagattacatggacctcacttgattatgataaaaaaccaaaggctgttccacaaaagataatccctccagctgaatcggcccagaggccatcatatccttcctcaaaatccaagaaagactgggataaactggaagctgaagttaaaaaggaggagaaggaggagaagcttgaaggcgatgctgcattgaacaaatttttccgtgacatctacagtgatgctgatgaagacatgcgacgagcaatgatgaaatcttttgttgaatctaacggtactgttctgtcgaccaattggaaagatgttggctcgaagaaggtagagggaagcccacctgatgggatggagcttaagaaatgggagtactaagatctcggttcgtgcatgctgtaaattcgttatcgtcgtgagtcatcacttggctggagatttcgcgcatcattgtcaagttggattttgtgtgatgctcttcgttgcgtttccatattgtaagctctctgtgtgacaggctagcttgtctaagactttatcctagttttggaagatacatctggacacaagaatacgttatctgaatctttgctccgaagtgcagaatgctctgtcgttttactaatattgcaaagtagtgctgtatctcctatcatccctgaaatgcgatgttcgtcttaattgtagcctctacaatgctcacagtta

SEQ ID NO: 20 - protein, 367 aa, Oryza sativa
MATAAASDLESKAKAAFVDDDFELAAELYTQAIEASPATAELYADRAQAHIKLGNYTEAVADANKAIELDPSMHKAYLRKGAACIRLEEYQTAKAALELGYSFASGDSRFTRLMKECDERIAEELSEVPVKKAEDGAAAPSVASFVEEKDDAANMDNTPPMVEVKPKYRHDFYNSATEVVLTIFAKGVPAENVVVDFGEQMLSVSIEVPGEEPYHFQPRLFSKIIPEKSRYQVLSTKVEIRLAKAEQITWTSLDYDKKPKAVPQKIIPPAESAQRPSYPSSKSKKDWDKLEAEVKKEEKEEKLEGDAALNKFFRDIYSDADEDMRRAMMKSFVESNGTVLSTNWKDVGSKKVEGSPPDGMELKKWEY

SEQ ID NO: 21 - DNA, 281 bp, Populus trichocarpa
tctcgaatcgatttttgttgaattcaatcgatggcggatctggagaagaaagccaaagaagcattcatcgacgatcacttcgagttagccgtcgatctctacacccaagccatcgctcttaaccctaccaatcctgacctcctcgctgaccgtgctcaggccaatatcaaactcaacagtctcaccggtatgcttaactaaccctcgctccaccaccaccacaacatcaacccctctctctcctttatatcgcttcactttctctcgcttgctctctgttt

SEQ ID NO: 22 - protein, 56 aa, Populus trichocarpa
MADLEKKAKEAFIDDHFELAVDLYTQAIALNPTNPDLLADRAQANIKLNSLTGMLN

SEQ ID NO: 23 - DNA, 1190 bp, Populus trichocarpa
tctgtatttcttggttgttgaaaagaatcaatggcggatctggagaggaaagcgaaagaagcattcatcgatgaccacttcgagctagccgtagatctctacacgcaagccatcgcgcttaaccctaccaatcctgacctcttcgccgaccgcgcgcaagccaatatcaaactcaacaatttcaccgaggctgttgcggatgctagcagagcaattgcgttggatgcctccttggctaaagcttacttgcggaaaggtattgcatgtatgaaacttgaggaatatcagactgctaaggcagcattggaagtaggcgcgtctttggcaccgggagagtctagattcactaacttgatcaaggaatgtgacgagtgcatcgcagaggaaactggtgggtcgaaaaatcatgcagcagatgccccagttaacactgtttccatagaagatgtcgagccagaagacacttctagtcaggctccaatggtaataccttccaagccaaagtacaggcatgaattctaccaaaagccagaagaggtggttgtgagtatatttgcaaagggcgtacaagccagttggattagtgttgattttggtgaacagattctaagtgttaggattgaggttcctggtgaagatgggtatcattttcaacctcgcttatttgggaagataatacccgacaagtgcaagtataacatcttgtccaccaaagttgaatttcgacttgcaaaagctgaaccaggtctgcactgggcatctcttgaatacaacaaggagacagcagtagtacaaaggattgctgtatcctctgaaattgttcaaaagcctacctattcctcatcaaaaccaaaacgagttgattgggacaagattgaagctcaagtaaagaaggaggagaaagaagagaagctagatggggatgcagctttgaacaaatttttccgagaaatttatcaagatgctgatgaagacacaagaagagccatgaaaaaatcttttgtggagtccaacggcacggtgctgtcgacaaactggaaagaagtgggtacgaagaaggtggaaggaagccctcctgatgggatggagatgaggaaatgggagtactgagcttgtgttttggtaatggggaatgcgctgtaaagaacataacagttagattttgttccctgaatgatgattgtggttgt

SEQ ID NO: 24 - protein, 359 aa, Populus trichocarpa
MADLERKAKEAFIDDHFELAVDLYTQAIALNPTNPDLFADRAQANIKLNNFTEAVADASRAIALDASLAKAYLRKGIACMKLEEYQTAKAALEVGASLAPGESRFTNLIKECDECIAEETGGSKNHAADAPVNTVSIEDVEPEDTSSQAPMVIPSKPKYRHEFYQKPEEVVVSIFAKGVQASWISVDFGEQILSVRIEVPGEDGYHFQPRLFGKIIPDKCKYNILSTKVEFRLAKAEPGLHWASLEYNKETAVVQRIAVSSEIVQKPTYSSSKPKRVDWDKIEAQVKKEEKEEKLDGDAALNKFFREIYQDADEDTRRAMKKSFVESNGTVLSTNWKEVGTKKVEGSPPDGMEMRKWEY

SEQ ID NO: 25 - DNA, 1407 bp, Solanum lycopersicum
ccaattgccatttcactcttgttctagatacttctttggagttcctctccatcaccaatggcgtccgatctggagactagggctaaagaggcattcattgacgaccactttgaactcgccgttgacctgtacactcaagccataacgctgagccctaagaaccctgaacttttcgccgaccgtgctcaggccaatatcaaactcaactacttcactgaagctgttgttgatgcgaacaaggccattgagttggatcctacaatgtcaaaagcatatttacgcaaggggttggcctgtatgaagcttgaagaataccaaactgcaaaggcagctttggaaattggtgccagtttagcaccaggagagttaagattcagtaagctaatgaaagaatgtgatgaacatattgcagaggaagctggcgaattgcctaatctgtcggtggataaaacctcagctagtgttgttgcacatcctgcatctgagttaccggacaatgttgctattgcgcctgaaggtgctcaaccaacggtcaaccagtcccatcaaggatctgctgccaaaccaaaatacagacatgaattttatcagaaaccagaggaggtggtggtgactatatttgccaagggcataccagccaagaatgttgttgttgactttggtgaacaaatacttagtgttagcattgatgtgccaggtgaagaaacttattctttccagcctaggttgtttggcaagataacacctgcaaaatgcagatacgaagtgatgtctaccataattgagatccgccttgcgaaagctgagctgttacactggacatcgcttgagtatacaacggaacctgttgtaattcagaggcctattgtgtcatcagctgccccgcggcccagttatccttcctcaaaactgagaaatgtagattgggataaactagaagctgaagtgaaaaaagaggaaaaagatgaaaaattggatggagatgcagcattgaacaaatttttcagagacatttaccaagatgctgacgaggacactagaagagctatgatgaaatcctttgtggaatctaatgggactgttttgtcgacaaactggaaagaagttggcacaaagaaggttgaaggaagccctccggatggcatggagctgaagaaatgggagatctagaatcgatcctctgttgatgttttttgactttgcattttaagttgtttcattgctatttttattatagaagaatttgttcatattttcttttctaaggttttaagttttgttctttgctgttggattgagataacagtaatatatcttcaaattgtggacaaagcaaaaaaaaaaaaaaaaaaaaaaaaaaaaaacatgtcggccgcctcggccctcgaggcatctatgtcgggtgcg

SEQ ID NO: 26 - protein, 370 aa, Solanum lycopersicum
MASDLETRAKEAFIDDHFELAVDLYTQAITLSPKNPELFADRAQANIKLNYFTEAVVDANKAIELDPTMSKAYLRKGLACMKLEEYQTAKAALEIGASLAPGELRFSKLMKECDEHIAEEAGELPNLSVDKTSASVVAHPASELPDNVAIAPEGAQPTVNQSHQGSAAKPKYRHEFYQKPEEVVVTIFAKGIPAKNVVVDFGEQILSVSIDVPGEETYSFQPRLFGKITPAKCRYEVMSTIIEIRLAKAELLHWTSLEYTTEPVVIQRPIVSSAAPRPSYPSSKLRNVDWDKLEAEVKKEEKDEKLDGDAALNKFFRDIYQDADEDTRRAMMKSFVESNGTVLSTNWKEVGTKKVEGSPPDGMELKKWEI

SEQ ID NO: 27 - DNA, 1110 bp, Solanum lycopersicum
atggcgtccgatctggagactagggctaaagaagctttcatcgatgaccactttgagctcgccgttgacctttacactcaagccatagccatgacccctaagaacgctgagcttttcgccgaccgtgctcaggccaatatcaaactcaactacttcactgaagctgttgttgatgcgaacaaggccattgagttagatccttcaatgtcaaaagcatatttgcgtaaggggttggcctgtatgaagcttgaagagtaccaaactgcaaaagcagctttgcaaactggtgctagtttagcaccggcagagtcaaggttcacaaagttaatcaaagaatgtgatgaacgcattgcagaggaagctggagaactacctaatcagtcagtggataaaacctcgggaaatgtcgttacggctccccctgagtctttggacaatgttgctgttgcgcctaaagatgctcaaccatctgtcaacctgtcctatcaaggatctgctgccagaccaaaatacaggcatgaattttaccagaagccagaggaggtggtggtgactatatttgccaagggtataccagccaagaatgttgttgttgactttggtgaacaaatacttagtgttagcattgatgtgccgggcgaggaagcttattctttccagcctaggttgtttgggaagataacacctgcaaaatgcagatacgaagtgatgtctaccaaaattgagatccgccttgcaaaagctgaacccttacactggacatctctcgaatatacgagggagcctgctgtagtgcagaggcctaatgtgtcatcagatgccccccggcccagttatccttcctcgaaattgagacatgtggattgggataaattagaggctgaagtgaaaaaggaggaaaaagacgaaaaattggatggagatgcagcattgaacaaatttttccgagacatttacaaagacgccgatgaggacaccagaagagccatgatgaaatcctttgtggaatctaatgggactgttctttccacaaactggaaagaagtcggtgcaaagaaggtcgaaggaagccctccagatggcatggagctgaagaaatgggagatctag

SEQ ID NO: 28 - protein, 369 aa, Solanum lycopersicum
MASDLETRAKEAFIDDHFELAVDLYTQAIAMTPKNAELFADRAQANIKLNYFTEAVVDANKAIELDPSMSKAYLRKGLACMKLEEYQTAKAALQTGASLAPAESRFTKLIKECDERIAEEAGELPNQSVDKTSGNVVTAPPESLDNVAVAPKDAQPSVNLSYQGSAARPKYRHEFYQKPEEVVVTIFAKGIPAKNVVVDFGEQILSVSIDVPGEEAYSFQPRLFGKITPAKCRYEVMSTKIEIRLAKAEPLHWTSLEYTREPAVVQRPNVSSDAPRPSYPSSKLRHVDWDKLEAEVKKEEKDEKLDGDAALNKFFRDIYKDADEDTRRAMMKSFVESNGTVLSTNWKEVGAKKVEGSPPDGMELKKWEI

SEQ ID NO: 29 - DNA, 491 bp, Solanum lycopersicum
atcccttttccctctcttgttcaagaaacttcttctcatctgatccatggcgtccgatctcgtaactaaagctaaagaagcattcatcgacgaccactttgagctcgccgttgacctctactctcaagccattgctattactcctaataatgccgacctttttgctgaccgtgctcaggccaatatcaaactccgtaaattcactggtaacttatttgttaatatggtccctttgcattctcggtaacaaggacaaacaaatgcatactctgttttttgttttttcttttggttgcgtaaacaaatggatatctatggcatgcatttgttccatagtatttttgtgattgtgattaattttgagcagaagctttttctgattttaacaaggcgattgagttagatccgtcaacggcaaaagcatatatgcgcaaggggtgagtatatcaatcatttctattggtatgcttctttgtgacgatgacgttatc

SEQ ID NO: 30 - protein, 66 aa, Solanum lycopersicum
MASDLVTKAKEAFIDDHFELAVDLYSQAIAITPNNADLFADRAQANIKLRKFTGNLFVNMVPLHSR

SEQ ID NO: 31 - DNA, 1104 bp, Triticum aestivum
  misc_feature (19)..(19): n is a, c, g, or t
  misc_feature (24)..(24): n is a, c, g, or t
cccacgcgtgccgaagctnacctncggaagggctctgcttgcatcaagctggaggaataccaaactgcaaaggctgctcttgaagtgggttcttcttatgcatctggtgactcgaggtttactcgtctgatgaaggagtgtgatgatcgtattgctgaggagggctagccaggtgccagtaaagaatgccgctgcggctgttgcttcagctacatcttcgggggcatcttccggggctacaactgtggctactgaagctgaggaccaggatggtgcaaatatggagaatgcacagccaacggtggaagtgccaagcaagcccaaatacaggcatgactactacaatactcctacagaagtggtactgactatatttgctaagggtgttccagctgacagcgtggttgttgactttggtgaacagatgctgagtgtctcaattgaacttcccggtgaggaaccataccattttcagcctcgtctgttttcaaagatcgtcccagataagtgcaagtatactgtgttgtctacaaaggttgaaatgcgccttgcaaaagctgagccagtaacttggacatcattggattatactggtaaaccaaaggctcctcagaagataaatgtaccagctgaatcagcccagaggccatcttatccatcatcaaaatccaaaaaggactgggataagcttgaagctgaagtgaaaaaacaggagaaggatgaaaaacttgatggcgatgctgcattgaacaaatttttccgtgaaatttacagtgatgctgatgaagatatgcgtagagcaatgatgaagtcttttgtggagtctaatggaaccgttctctcaaccaactggaaggatgtcgggaaaaagacggttgaaggaagccctcctgatggaatggagctcaagaagtgggagtattaatgaatccagatcatccatgttgtaaatcctggtcgggtcgtgagtgttaacttggttgcagacttgcaaatcttggcgccggatttttggggtgggcctgaatcgttcccatattgaacccgttggcttcggggtactcttaggtcctttctcaatttcggaccaaagggggaaaaaaa

SEQ ID NO: 32 - protein, 260 aa, Triticum aestivum
MIVLLRRASQVPVKNAAAAVASATSSGASSGATTVATEAEDQDGANMENAQPTVEVPSKPKYRHDYYNTPTEVVLTIFAKGVPADSVVVDFGEQMLSVSIELPGEEPYHFQPRLFSKIVPDKCKYTVLSTKVEMRLAKAEPVTWTSLDYTGKPKAPQKINVPAESAQRPSYPSSKSKKDWDKLEAEVKKQEKDEKLDGDAALNKFFREIYSDADEDMRRAMMKSFVESNGTVLSTNWKDVGKKTVEGSPPDGMELKKWEY

SEQ ID NO: 33 - DNA, 1444 bp, Zea mays
ctcgattattctgtttgctctcgttcaagtcatcgtctggtcgcgtcggcagcagacgcccagagccggagggagcgccatggccgcgtcggatctggagagcaaagccaaggaggccttcgtcgacgacgacttcgagctggccgccgaactctacacgcaggccatcgacgccgggcccgccactgccgatctctacgccgaccgcgcccaggcgcacatcaagctcggcaactacactgaggctgtggcagatgctaacaaagcaattggtcttgatcctacaatgcataaagcctactaccggaaaggtgctgcatgcattaagcttgaagaataccaaactgcaaaggctgctcttgagttaggttcttcctatgcaccaggcgattcaaggtttacccgtctattgaaggaatgtgatgagtgcattgctgaggaatctagccaggcaccagcaaagaatgtcgaggctcctgtagctgctactgttgaggacaaggaggatgtcgcaaatatggataatacaccgccagtggtagaacccccaagcaaacctaaatataggcatgactactacaacagtgccacagaagtggtcctcacaatatatgctaagggtgttcctgctgatagtgtagtcattgattttggtgatcagatgttgagtgtatccattgaagtacctggtgaagaaccgtaccattttcagccccgtctgttttctaagattatccctgagaaatgcaagtatcaagttttatccaccaaggtcgaaatacgccttgcaaaagctgagcaggtgacatggacaaccctggattatagtggaagaccaaaggctattccccagaagataagcacgccagctgaaacagccccaagaccttcatacccatcttcaaagtcaaaaaaggactgggataaactggaagctgaagtaaaaaaggaggagaaggaagaaaaacttgaaggtgatgctgcattgaacaagttcttccgtgatatctacaaggatgctgatgaagatatgcggagggccatggacaagtcattcagggaatctaatggtaccgttctctcaaccaattggaaagatgttggatcaaagacggtggaagcgagccctcctgatggtatggagctcaagaagtgggaaatttgaagtttggactgcccctcttgtaaatccaggtcttggaagttatgacctagttctgtccacccatttggtgtcgtaagtttggttaagtgtgtgtgtgtttttggttcagctgtcgttcgaggaaaagctattgtaagttgtggactgtgtaaaagctgcaatagattgtgggttgtgaaaaaggtgtatgctgtttaatttaaacaagcataaaacttaaaaaaaaaaaaaaaaaaaaaaaaaaaaaaaaaaaaaaaaaggggggggggaaaaaaaaaa

SEQ ID NO: 34 - protein, 361 aa, Zea mays
MAASDLESKAKEAFVDDDFELAAELYTQAIDAGPATADLYADRAQAHIKLGNYTEAVADANKAIGLDPTMHKAYYRKGAACIKLEEYQTAKAALELGSSYAPGDSRFTRLLKECDECIAEESSQAPAKNVEAPVAATVEDKEDVANMDNTPPVVEPPSKPKYRHDYYNSATEVVLTIYAKGVPADSVVIDFGDQMLSVSIEVPGEEPYHFQPRLFSKIIPEKCKYQVLSTKVEIRLAKAEQVTWTTLDYSGRPKAIPQKISTPAETAPRPSYPSSKSKKDWDKLEAEVKKEEKEEKLEGDAALNKFFRDIYKDADEDMRRAMDKSFRESNGTVLSTNWKDVGSKTVEASPPDGMELKKWEI

SEQ ID NO: 35 - DNA, 1446 bp, Zea mays
ttcgattattctgttcgctctcgcccaagtcatcgtctggtcgtcgcccgcagaggcgcagacgcccaaaaccggaaggggcgccatggccgcgtcggatctggagagcaaggccaaggaggccttcgtcgacgacgacttcgagctggccaccgagctctacagccaggccatcgacgccgggcccgccaccgccgacctctatgccgaccgcgcccaggcgcacatcaagctcggcaactacactgaggctgtggcggatgctaacaaagcaattgagcttgatcctatgatgcataaagcttactaccggaaaggtgctgcatgcattaagcttgaagaataccaaactgcaaaggctgctcttgagttgggttcttcttatgcatcaggcgattcaaggtttgctcgtctattgaaggaatgtgatgagcgcatcgctgaggaatctagccaggcaccagtaaagaatgttgaggctactgtggctgctactattgaggacaaggaggatttcacaaatatggagaatacaccaccagtgatagaacccccaagcaaaccaaaatacaggcatgactactacaacagtgccacagaagtggtactgacaatatttgctaagggtgttcctgctgatagtgtagtcattgattttggtgaacagatgttgagtgtatccattgaagttcctggtgaagaaccataccattttcagccccgtctgttttctaagattatccctgagaaatgcaaatatcaagtcttatccaccaaggttgaaatacgccttgcaaaagctgagcaggtgacatggacaaccctggattatagtggaagaccaaagactgttccccagaagataagcacgccagctgaaacagccccaagaccttcatacccatcttcaaaggcgaaaaaagactgggataaactggaagctgaagtcaaaaaggaggagaaggaagaaaaacttgatggtgatgctgcattgaacaaattcttccgtgacatctacaaggatgctgatgaagatatgcggagggccatgatgaagtcattcgtggaatcaaatggcactgttctctcaaccaattggaaagatgttggagcaaagaaggtagaagggagcccccctgatggtatggagctcaagaagtgggaatactaaagtttggactgcccatcttttgtaaatccaggtcttggaaactatgacctaattccgtccacccatagtgccatgagcttgcttggttaagtctctgcttttgtaagctttctgtatgacagtctagcgtgtgtctgagtgctacttgccgtagcttttgatggacataggtatgctattatgtggtatcgaccgggaaccatctgtggtatcaaagacagcaaactataatgtatggaatgcctattctttttggtcgaaaaaaaaaaaaaaaa

SEQ ID NO: 36 - protein, 361 aa, Zea mays
MAASDLESKAKEAFVDDDFELATELYSQAIDAGPATADLYADRAQAHIKLGNYTEAVADANKAIELDPMMHKAYYRKGAACIKLEEYQTAKAALELGSSYASGDSRFARLLKECDERIAEESSQAPVKNVEATVAATIEDKEDFTNMENTPPVIEPPSKPKYRHDYYNSATEVVLTIFAKGVPADSVVIDFGEQMLSVSIEVPGEEPYHFQPRLFSKIIPEKCKYQVLSTKVEIRLAKAEQVTWTTLDYSGRPKTVPQKISTPAETAPRPSYPSSKAKKDWDKLEAEVKKEEKEEKLDGDAALNKFFRDIYKDADEDMRRAMMKSFVESNGTVLSTNWKDVGAKKVEGSPPDGMELKKWEY

SEQ ID NO: 37 - protein, 34 aa, Artificial sequence
  Protein sequence of Type 1 tetratricopeptide repeat (TPR1)
SKAYLRKGLACMKLEEYQTAKAALETGASLAPGE

SEQ ID NO: 38 - protein, 34 aa, Artificial sequence
  Protein sequence of Type 2 tetratricopeptide repeat (TPR2a)
ASDLETRAKEAFIDDHFELAVDLYTQAISLSPKN

SEQ ID NO: 39 - protein, 34 aa, Artificial sequence
  Protein sequence of Type 2 tetratricopeptide repeat (TPR2b)
PELFADRAQANIKLNYFTEAVVDANKAIELDPYM

SEQ ID NO: 40 - protein, 77 aa, Artificial sequence
  CS domain
YRHEFYQKPEEVVVTIFAKGIPAKNVVVDFGEQILSVSIDLPGGETYSFQPRLFGKITPAKCRYEVMSTKIEIRLAK

SEQ ID NO: 41 - protein, 82 aa, Artificial sequence
  SGS domain
NVDWDKLEAQVKKEEKDEKLDGDAALNKFFRDIYKDADEDTRRAMMKSFVESNGTVLSTNWKKVGTKKVEGSPPDGMELKKW

SEQ ID NO: 42 - protein, 26 aa, Artificial sequence
  motif 1
DLETRAKEAFIDDHFELAVDLYTQAI

SEQ ID NO: 43 - protein, 10 aa, Artificial sequence
  motif 2
ADRAQANIKL

SEQ ID NO: 44 - protein, 16 aa, Artificial sequence
  motif 3
LEEYQTAKAALETGAS

SEQ ID NO: 45 - protein, 23 aa, Artificial sequence
  motif 4
KYRHEFYQKPEEVVVTIFAKGIP

SEQ ID NO: 46 - protein, 30 aa, Artificial sequence
  motif 5
QPRLFGKITPAKCRYEVMSTKIEIRLAKAE

SEQ ID NO: 47 - protein, 17 aa, Artificial sequence
  motif 6
EAQVKKEEKDEKLDGDA

SEQ ID NO: 48 - protein, 47 aa, Artificial sequence
  motif 7
ALNKFFRDIYKDADEDTRRAMMKSFVESNGTVLSTNWKKVGTKKVEG

SEQ ID NO: 49 - protein, 13 aa, Artificial sequence
  motif 8
SPPDGMELKKWEI

SEQ ID NO: 50 - DNA, 1264 bp, Oryza sativa
tcgacgctactcaagtggtgggaggccaccgcatgttccaacgaagcgccaaagaaagccttgcagactctaatgctattagtcgcctaggatatttggaatgaaaggaaccgcagagtttttcagcaccaagagcttccggtggctagtctgatagccaaaattaaggaggatgccaaaacatgggtcttggcgggcgcgaaacaccttgataggtggcttaccttttaacatgttcgggccaaaggccttgagacggtaaagttttctatttgcgcttgcgcatgtacaattttattcctctattcaatgaaattggtggctcactggttcattaaaaaaaaaagaatctagcctgttcgggaagaagaggattttgttcgtgagagagagagagagagagagagagagagagagagagaaggaggaggaggattttcaggcttcgcattgcccaacctctgcttctgttggcccaagaagaatcccaggcgcccatgggctggcagtttaccacggacctacctagcctaccttagctatctaagcgggccgacctagtagccacgtgcctagtgtagattaaagttgccgggccagcaggaagccacgctgcaatggcatcttcccctgtccttcgcgtacgtgaaaacaaacccaggtaagcttagaatcttcttgcccgttggactgggacacccaccaatcccaccatgccccgatattcctccggtctcggttcatgtgatgtcctctcttgtgtgatcacggagcaagcattcttaaacggcaaaagaaaatcaccaacttgctcacgcagtcacgctgcaccgcgcgaagcgacgcccgataggccaagatcgcgagataaaataacaaccaatgatcataaggaaacaagcccgcgatgtgtcgtgtgcagcaatcttggtcatttgcgggatcgagtgcttcacagctaaccaaatattcggccgatgatttaacacattatcagcgtagatgtacgtacgatttgttaattaatctacgagccttgctagggcaggtgttctgccagccaatccagatcgccctcgtatgcacgctcacatgatggcagggcagggttcacatgagctctaacggtcgattaattaatcccggggctcgactataaatacctccctaatcccatgatcaaaaccatctcaagcagcctaatcatctccagctgatcaagagctcttaattagctagctagtgattagctgcgcttgtgatc

SEQ ID NO: 51 - DNA, 51 bp, Artificial sequence
  primer: prm14133
ggggacaagtttgtacaaaaaagcaggcttaaacaatggcgtccgatctgg

SEQ ID NO: 52 - DNA, 52 bp, Artificial sequence
  primer: prm14134
ggggaccactttgtacaagaaagctgggtcacaaaagataaacagcagattg

SEQ ID NO: 53 - DNA, 2700 bp, Synechocystis sp.
ttactcgtctagaccgaaatctggggccaggggagggacgatcgcctcttcgttgggggagtccactggaccgcggaaaataaacacagtggtgttggtttggctagcgatttgggtgggtaaattgccgtggatgacatttttgagcaatccttccctactggcccccagcacgattgccgcacattcacgcatttccgccaggtcactgagggcatcggcaatggaagtggagcacacaggaatgggaataatcggtctttgtaactgttctgaccaccgttctgccaggttttttaaatcgtaaaaagggtcatagcgctgggattgacggggtagataaactttagaaatcagtagctgggggttattttcctccgggtaaagggaaaacaacgccggcaacagatttaacattttttcaatgttggggcctcccgctaccggcattaaccagtgggccatgggggataaatagcggggataggcgtggtcattggtgccctgtttaaccattaataaagagcagggggcttggtcaatcaggcgatccgtgatttggccaaaaatttggccgccaatgggcatttccccttgccattcaaggattagcaggtcgctatggcgggtttgaatggtatcaaggatggtgtcggtaatgctgtaggccagcttgatttccgtatggaataacactctctggtggcgggcaatgcgttccagtttttgcatcagttgccgttgcctctgccattgcaccctttgcacagaaggggattgagctttagataccttgaccacctgcaaacagtcaatttcgtagttttgctttttggcgattgccgccgcaatttgaaacaaaactaaagcactatcggagtcccggatgggtaataaaatgcgcccttctcccaccaacggcgatcgggtttggtatacgctgtaggcgggatggggaggatggataatttgcccccctaactgactcacttcctcccgaataatgtctgtgcgggtgataatgcccactaatttgttgtccccttccaccaccggcaaccgggaaagttgataacggttgagcaaatagagcacatcactgaggggcgcttccggatctacagtgatgggattgggggtcataatttgcttaagggcaatgtgcaccgactcctgggccgcattggccaaatccgtttgggtaaatacccccaccagtttgcccccctgcaccacgggaaagccccggtgatgggaattggacataatcggtagcacctgggctagggtgagactctgctccaggctttccacctccgttttcattacctggccagctcggatatcagcgagaaagtcatggtctggcttttcctctgccaaaaaaatgcccttggtttccagcaaatgatcgtacaaagaacggggaaagagactttccgccactagataggacgtggcacaggccaccatcaggggaagcaccacgttgaaattgcccgttagctcaaaaacaatgatgatcgccgtcactggcacccgcaccacactagtgaaaaaagcgcccatccccgccagggcaaaggtagtttgggtaacttgatcttgccaataactgccaaattcccccaccagataacccagggccgaccccatcactaaagccggcgcaaataatcctcccggcgcatcggtgctgtaggccaggatagtcaaaatgaaatgggccactaaggtcaaaactacctgatgccaactcagttctccggaagtaacaaattccctcagccctgcattgtcccgaaaaaagctcggcaatagggcgatcgccacgccggaaattaagcccacaacaccaatgcgaataaccagggaaaggttctgttttctttgccagttttgcagggagagaatactgcggttgagcaaaacccccaaaatgccagccaaaattcccagtaaaagatagaaaggaatctcccccgtagtaaaacgcaccgttgggctattgcttaagctatgggccaggttaaggtcactggattggaataccaaagacgtgacagcccccacgaaggaagcgacgatcgccgtttctagggtcaagctagacacatcccgcattaattcttccaccacaaacaaaaccccagcaatgggggtggtgaagcccgccgctaatcccgccgccgccccggccgcaatcatttgccgccgatgttccggggaagtgggaaaccaccgactcaactgggccgctagagctgcgccaatatgaaccgtgggagcccgccgtcccaaggtcatgcctccccccagcactagcactgttcccaacagcttgaccaccgccacccgccaatctaggggaataggataccgagccagggccgctttcacctggggaatgccaccgccccccgccggtcgggaaaattgttcaattaatgcccccgccaaacccccaaacaccaagccaaaacagggcagcacccaaatggccccataggtatccgccagactcaaacggctggaccctaaccagttgactccgtttttaattactaaggccgctagggcagaaacaaatccgatcacacaggcttcggcgatcgcataacggctatcgatggcagtgcggccatagtgtcgagagcgcaaccattgttgccaccgttgccaaaagggaaaccaagccat

SEQ ID NO: 54 - protein, 899 aa, Synechocystis sp.
MAWFPFWQRWQQWLRSRHYGRTAIDSRYAIAEACVIGFVSALAALVIKNGVNWLGSSRLSLADTYGAIWVLPCFGLVFGGLAGALIEQFSRPAGGGGIPQVKAALARYPIPLDWRVAVVKLLGTVLVLGGGMTLGRRAPTVHIGAALAAQLSRWFPTSPEHRRQMIAAGAAAGLAAGFTTPIAGVLFVVEELMRDVSSLTLETAIVASFVGAVTSLVFQSSDLNLAHSLSNSPTVRFTTGEIPFYLLLGILAGILGVLLNRSILSLQNWQRKQNLSLVIRIGVVGLISGVAIALLPSFFRDNAGLREFVTSGELSWHQVVLTLVAHFILTILAYSTDAPGGLFAPALVMGSALGYLVGEFGSYWQDQVTQTTFALAGMGAFFTSVVRVPVTAIIIVFELTGNFNVVLPLMVACATSYLVAESLFPRSLYDHLLETKGIFLAEEKPDHDFLADIRAGQVMKTEVESLEQSLTLAQVLPIMSNSHHRGFPVVQGGKLVGVFTQTDLANAAQESVHIALKQIMTPNPITVDPEAPLSDVLYLLNRYQLSRLPVVEGDNKLVGIITRTDIIREEVSQLGGQIIHPPHPAYSVYQTRSPLVGEGRILLPIRDSDSALVLFQIAAAIAKKQNYEIDCLQVVKVSKAQSPSVQRVQWQRQRQLMQKLERIARHQRVLFHTEIKLAYSITDTILDTIQTRHSDLLILEWQGEMPIGGQIFGQITDRLIDQAPCSLLMVKQGTNDHAYPRYLSPMAHWLMPVAGGPNIEKMLNLLPALFSLYPEENNPQLLISKVYLPRQSQRYDPFYDLKNLAERWSEQLQRPIIPIPVCSTSIADALSDLAEMRECAAIVLGASREGLLKNVIHGNLPTQIASQTNTTVFIFRGPVDSPNEEAIVPPLAPDFGLDE

SEQ ID NO: 55 - DNA, 2628 bp, Cyanothece sp.
atgaatatttatctgcccataaaacgcctacggggttggtttaaagccagacgctttggacggagttccgttgatacccgctacgccatgctagaagcttgtttaattgggattttatcggctgttgctgccttagtgttaaaacagggagtgggatggttagggggatggagactgagcctgacgagaacatttggagcgctctggatacttcctttagggggtttaatcttaggattactggcaggatgggtcatagaaattttatcaccggcagcggcaggaggaggaattccgcaagttaaggccgctttagctcgatttcccgttcccttatctttgcgggtagccctcgctaaattaatcggagctattttagtgttaggagcggggttgaccttgggacggagagcgcctacggttcatattggggcagctttagcagcgcaactgagtcaatggcttcccacttccccagaacatcgtcgtcaaatgattgcagccggagcagcctccggactagcagccggttttggaactcccatcgccggagttttatttgttattgaagaattgatgcgagatgtttctgggttgacattagagacggcgattattgcctcctttactggggcagtagtgtcgttattgctagagtctaccggtccgattatccctgcacctctaaacattaccttttctgcgcgagaaattcctttgtatcttttgcttggttttttagccggaattctaggggcgttatttaatgcgggtattctcttttgtatgagggtacaaaagcaacttagactaagcattccctggcgcataggcttagtttgcatgatttcaggggcggttattgcggtattacctcctttttttcgtgacaattctggattaagagaatttttaattacaggggaattaggttggcgtaatatcttattagcgttgattgcccatttttttctcactattttggcctatagttctagcgctccgggcggtctatttgcaccggctttagtgatgggatcagccctaggctatttagtgggggatttaggagaattattaacaggttcaggagcggctacaacttacgctttagcggggatgggagggttttttaccgcagtggttcgcgctccggtgacggccattgtgattgtctttgaattgagggctaattttaatattgtgctgcctttaatgattacctgtgcggtgtcttatttggtggctgaaaatgtgtttagtcggtctatttatgaacatttgctcgatgcgagtgggattcatttaaccgaagaaataccggttaatgatttcttgagtaaattaaaagcttctgatgtgatgcaatctcaggtagaaaccttagatagttatcttagccttgaggccgttttacaggccatgtcgatttctcgtcatcgagggtttccggtagtagaagagggaaaattagtgggaattgtgactcaaagtgatttgtcgaatctcggcgatcgctctgaggagcttaccctacgtcagattatgaccccaaaaccgattactgtgcaaccagaaacctccttaagtgatgttctttatttgctcaaccgttatcaattatcccgtttacccgtcaccgaaggacataaattagtcggcattattacccgcaccgatatcattcaagcagaggtgaagcaattgggagggggaacaatgcaaggatctaaacctgcaccttcctatgtcacctatcaaacccgttcgccggccttgggaaatggccgcattttattacccttatctgatggggaaatggccggaactttgttgcaaattgccgccgcgatcgcccgtcatcgcaactatgaaatagaatgtctccaagtgattaaagttcccagacatcaatttccctcagaagctaggatagatattcatcatagccgtaagttaatgcaacggatggaaagattggcgcgtcatctgaatgttcccgttcatactcaaattagaatcgctcaggatacagcacaatcgatcatagaaacaattcaggaacgacatataaatttaatgttgatgagttggaaaggaggaggagatactcaaggggcaatatttggcaatgttactgatacgttaattcataaagctccctgtgatttaatgttagtcaaattgggggcaagtcccactgcatatcctcacaacttagagcataatgcgacttggttagtgccgatggcaggagggccaaatgctcaacgagccattgaattattgccgagcttaacgacattatatgctaatcctaatgcgcctgagctttggttatgtaaagtctatcctcctacagaattagaacctaattcccaagcgttagaagaggcggcgcaaaccttaacagaaaagctcaataaatccattattcctatttctattcgttctcattctgtggctgatgctttgattcatttagcccaagcagaagtctgtgatttaattattttaggggcttctagagaagggttattacaacaggcaattcatggtaatattcctgatgcgatcgcttcgggggtggatagtacggttattgtcgtcaggggagcaattgattaa

SEQ ID NO: 56 - protein, 875 aa, Cyanothece sp.
MNIYLPIKRLRGWFKARRFGRSSVDTRYAMLEACLIGILSAVAALVLKQGVGWLGGWRLSLTRTFGALWILPLGGLILGLLAGWVIEILSPAAAGGGIPQVKAALARFPVPLSLRVALAKLIGAILVLGAGLTLGRRAPTVHIGAALAAQLSQWLPTSPEHRRQMIAAGAASGLAAGFGTPIAGVLFVIEELMRDVSGLTLETAIIASFTGAVVSLLLESTGPIIPAPLNITFSAREIPLYLLLGFLAGILGALFNAGILFCMRVQKQLRLSIPWRIGLVCMISGAVIAVLPPFFRDNSGLREFLITGELGWRNILLALIAHFFLTILAYSSSAPGGLFAPALVMGSALGYLVGDLGELLTGSGAATTYALAGMGGFFTAVVRAPVTAIVIVFELRANFNIVLPLMITCAVSYLVAENVFSRSIYEHLLDASGIHLTEEIPVNDFLSKLKASDVMQSQVETLDSYLSLEAVLQAMSISRHRGFPVVEEGKLVGIVTQSDLSNLGDRSEELTLRQIMTPKPITVQPETSLSDVLYLLNRYQLSRLPVTEGHKLVGIITRTDIIQAEVKQLGGGTMQGSKPAPSYVTYQTRSPALGNGRILLPLSDGEMAGTLLQIAAAIARHRNYEIECLQVIKVPRHQFPSEARIDIHHSRKLMQRMERLARHLNVPVHTQIRIAQDTAQSIIETIQERHINLMLMSWKGGGDTQGAIFGNVTDTLIHKAPCDLMLVKLGASPTAYPHNLEHNATWLVPMAGGPNAQRAIELLPSLTTLYANPNAPELWLCKVYPPTELEPNSQALEEAAQTLTEKLNKSIIPISIRSHSVADALIHLAQAEVCDLIILGASREGLLQQAIHGNIPDAIASGVDSTVIVVRGAID

SEQ ID NO: 57 - DNA, 2625 bp, Cyanothece sp.
ttaatcaatcgctcctcgtaccacaataaccgtactatcaaccccacgagcaatagcatcaggaatattcccatgaatagcctgctgtaataacccttcccgagacgctcccaaaacaatcacatcacactcttcggcgcgagctaattgtattaaagcatcagaaacagaattagaacgaatagaaataggaaaaatcggtttattcaatttatctcttaaaatttgagccgcttcttctaacccttgagaatccggttcaatctctgaaggaggataaactttacacagccacaactgaggggcatccggattagaatataatcgtgttaaactcggtaataattcaattgctcgttgagcatttggcccccccgccatcggcactaaccaagtagcattatgctctaaatttaggggataagcattagcactagctccaagtttaactaacattaaatcacagggagctttatgaatcaaggtatctgcaacactgccaaaaattgccccttgactatcactaattcctttccaactcattaacattaaactaatatgccgttgctgaatagtttctataatggattcagccgtatcctgagcgactctcacttgagtatgaacggcaatattcaaatgtcgccctaatctttccatacgctgcatcagcttgcggctatgatgaacctcaactcgagcttcagaaggaaattgatgtctaggaatcttaatcacttgcagacattcgatttcatagtggcgatgacgagcgatggttgcggcaatttgaaataaggttgcagccatctccggatcactaagcggcaataaaatccgtccattccccaaagccggcgaacgagtctgataaaccacataagacgggggcggtttagttccttgagttccgcctccgagttgcttaacttctgcttgaataatatcggtgcgggtaataatccccactaaaatatgtccttctgtcaccggtaaacgagataattgatagcggttgagtaaatagagaacatcacttaaagaggtttccggttgcacagtaatcggttttggggtcataatctcacgcagagatacatcgggtgagcgctcacccaaattcgataaatcactctgagtgacaattcccactaattttcccgcttctaccaccggaaacccgcgatgacgggatatagacatcgcctgtagcactttatctagagtaagatgactttctaagctttctacctgagactgcatcacatcagccgcttttaacttactcaagaaatcattaaccggcacttcctcgcttaaatgaatcccactcgcatcaagcaaatgttcataaatcgaacgactaaacacattttctgccaccaaataagacaccgcacaagtcagcatcaacggcagtacaatattaaaattagcctttaattcaaagacaatcacaatcgctgtcaccggagcgcgaaccaccgccgtaaaaaaccctcccattcccgccagcgcgtaagtggtagccgctcctgaacccgtcacccatccggctaattctcccacgatatagcccaaagcggaacccaacaccagcgccggggcaaataatcctccgggagcgcccgaactataagctaagatggttaggcaaaaatgagccacaaaagccaacagaatactacgccaacctaattccccagtgactaaaaactccctcagtcccgagttatcgcggaaaaaaggcggtaacagggcaatcactcccccagaaatcatacagactaagccaacccgccaaggcatcggcaatctcagccgcttttgtacgttcatacaaaagagaattccccaattaaataacgctcctagcattcccgctaaaaaaccgagcaaaagatatagaggaatttctcgagcggaaaagtttatgtttagaggtgcgggtataatgggaccagcagactcgagtaataaagataccactgccccagtaaaggaagccacgatggctgtttctaaagttaacccagagacatcgcgcatcaattcttcaaccacaaataaaactcccgctatgggagtcccaaaccccgccgctagtcctgaagcggccccggctgcaatcatctgtcgccgatgttctggggaagtgggaacccattgactcaattgagccgctaaggccgcccctatatgaactgtaggcgctcgccgcccaagggttaaccctgcgcctaatactaaggttgcccccagtaatttagcgatggctacccgtaaagacagaggcaccggaaagcgagctaaagcggctttgacttggggaatgcctccaccggcagccgccggtgagatcacttgtattaactgaccggccagtaatcctaataataatccgccgatgggaagtagccagactgccccaagtttagtagtaatatgaactcgccatcctcctaaccatcctaccccctgtttaaggagtaaggccgcgatcgccgataaaatcccgatgagacaagattccagcatggcatagcgggtatcgacggaactgcgtccgaaacgtctagctttaaaccaaccatgcaggcgttttaggggaaaaggtaaattcat

SEQ ID NO: 58 - protein, 874 aa, Cyanothece sp.
MNLPFPLKRLHGWFKARRFGRSSVDTRYAMLESCLIGILSAIAALLLKQGVGWLGGWRVHITTKLGAVWLLPIGGLLLGLLAGQLIQVISPAAAGGGIPQVKAALARFPVPLSLRVAIAKLLGATLVLGAGLTLGRRAPTVHIGAALAAQLSQWVPTSPEHRRQMIAAGAASGLAAGFGTPIAGVLFVVEELMRDVSGLTLETAIVASFTGAVVSLLLESAGPIIPAPLNINFSAREIPLYLLLGFLAGMLGALFNWGILFCMNVQKRLRLPMPWRVGLVCMISGGVIALLPPFFRDNSGLREFLVTGELGWRSILLAFVAHFCLTILAYSSGAPGGLFAPALVLGSALGYIVGELAGWVTGSGAATTYALAGMGGFFTAVVRAPVTAIVIVFELKANFNIVLPLMLTCAVSYLVAENVFSRSIYEHLLDASGIHLSEEVPVNDFLSKLKAADVMQSQVESLESHLTLDKVLQAMSISRHRGFPVVEAGKLVGIVTQSDLSNLGERSPDVSLREIMTPKPITVQPETSLSDVLYLLNRYQLSRLPVTEGHILVGIITRTDIIQAEVKQLGGGTQGTKPPPSYVVYQTRSPALGNGRILLPLSDPEMAATLFQIAATIARHRHYEIECLQVIKIPRHQFPSEARVEVHHSRKLMQRMERLGRHLNIAVHTQVRVAQDTAESIIETIQQRHISLMLMSWKGISDSQGAIFGSVADTLIHKAPCDLMLVKLGASANAYPLNLEHNATWLVPMAGGPNAQRAIELLPSLTRLYSNPDAPQLWLCKVYPPSEIEPDSQGLEEAAQILRDKLNKPIFPISIRSNSVSDALIQLARAEECDVIVLGASREGLLQQAIHGNIPDAIARGVDSTVIVVRGAID

SEQ ID NO: 59 - DNA, 2634 bp, Cyanothece sp.
ctaattatctaactttcctcgcactaaaatgacggtacttttcacttgttgagcgatcattttaggaatatttccttgcatcacttgaactaataacccttcgcgactgacccctaacataaccacatcacagctttctgcttcagctaaatgaatgatcgcatctgcgacagactgggaacgaacagggaggggaataacaggacgttctagttcttcttttaagcgtttagcttcaatttctaaggcttgataattaggggtcgatttatgggggggaaatacttgacataaccaaataataggggatcgaggacgagtatataattttgttaatccgggtaacaattccatagcccgtttggcattgggaccaccagcaataggaattaaccaagtggtatctttatctaaaatttggggataagcttctttttcttgtcccaattttactaagattaattcgcaagtcgctttgcgaattaaaatgtcaatgactggatcaaaaatggttcctggggtgtgatggtcatcggtccactctaacaccatgagattaatgtgtcgttctcgaatggtgtctaaaatggcttgagcgcgatcgtgggcgacacgaatttgagtatgaactgggatatgatagtgacggcctaatctttcagttctttgtaacaattgacgactgtgttgggtaattacgggggtttgagcaggatcactatgtttgggaacggtaatcacctgtagacattcaatttcttggttttgttgttgagcgatcgctgaactaattttaaacagagacgtagccgtatcagggttaactaaaggtaataaaatacgaccgtctccagctaagggggcccgagtttgataggcaatataggaaggatcaggaaccacttcgttaatggtggtatcatccccttgtaattgattggcttcaacccgaataatatccgttcgagtgataattcccactaacttatgaccttctgtcacaggaagacgggacaactgataacggttcagcagatataaaacatcactcagagacgcttctgcttgcactgtaatgggtcttcgggtcataaactcctgtaaaggagtatatcctggttctttttttaatttcgccagatccgtttgagtaacaatgcccaccagttgaccttgctctaccacaggaaaccctcgatgactggagttagacatggcttgtagcacttcatctagcgttaaatcactagataaggtttcgacttgagactccatcacctgagaagcggttaattttgagagaaaatcttgtcctgtggccgcttcgttgatatagataccccgagcgtgtaacatatgttcgtacagagaaccccgtgaaacactttcggccacgatataagacaccgcacaagtgaccattaggggtaagactatgttaaagtctgtattcagttcaaagacaaagacgatcgctgttactggtactctaaccactgccgtaaaaaaggctcccattcctgctagagcataacttgattgtgcgccagttcccgtcacaaattgttcaaaatctcctaccaaatagcctaaagccgatcctaacaccagagccggaccgaataaccctccaggagcattgcaactataggccaaaatggtgaggaaaaaatgagccacaaacgctaataaaattcgactcccatctaattctcctgtaactaaaaagatgcgaagtcctgcattatcccgaaagaaaggaggcaataaagcgataataatgcctgacaccattcccattaagccaatacgccaggataagggtaaattgaactttctttgtattgtgacactggttaggagtccccgattaaataacgcccctaatagtccggctaaaatgcctagaagtagataaaaaggaatgtctgagatagaaaaggtaatatcgggcagttccagtagtgaagagggaaaattgagggtagatgactgtaaaattaacgaaaccaccgctccggtaaaggaggcaacgatagccgtttctaaggttaaccctgaaacatctcgcatcaactcttcaatgacaaacaaaaccccggcaataggcgttgtaaaaccggctgctagtcctgctgctgctccggctgcgatcatttgtcgtcgatgttctggggaggtgggaacccagttactcagttgtgctgctaacgctgccccaatatgcactgttggtgcgcgacggcctaaggttaaacctccgcctaacactaaaatggttccaataagtttaaccactgctacccgtaaggataagggaactggatatcgagctaaagctgcttttacttgagtgataccgcctcctgtagcagttggggaaaaggtttcaatgatcaaacccgataaataacctaagatcagtccgcctaaaggaagcacccacattgccccaaactggttggctaaagcgacacgccaaccccctaaccaaccgactccttgtttcagaattaaggcagcgatcgcagaaagcactccaattaaactggcttcaactaaggcataacgggtatccgtggcattaaatgccaattttctcgatttgagccattgataaaaacgtcgaggcat

SEQ ID NO: 60 - protein, 877 aa, Cyanothece sp.
MPRRFYQWLKSRKLAFNATDTRYALVEASLIGVLSAIAALILKQGVGWLGGWRVALANQFGAMWVLPLGGLILGYLSGLIIETFSPTATGGGITQVKAALARYPVPLSLRVAVVKLIGTILVLGGGLTLGRRAPTVHIGAALAAQLSNWVPTSPEHRRQMIAAGAAAGLAAGFTTPIAGVLFVIEELMRDVSGLTLETAIVASFTGAVVSLILQSSTLNFPSSLLELPDITFSISDIPFYLLLGILAGLLGALFNRGLLTSVTIQRKFNLPLSWRIGLMGMVSGIIIALLPPFFRDNAGLRIFLVTGELDGSRILLAFVAHFFLTILAYSCNAPGGLFGPALVLGSALGYLVGDFEQFVTGTGAQSSYALAGMGAFFTAVVRVPVTAIVFVFELNTDFNIVLPLMVTCAVSYIVAESVSRGSLYEHMLHARGIYINEAATGQDFLSKLTASQVMESQVETLSSDLTLDEVLQAMSNSSHRGFPVVEQGQLVGIVTQTDLAKLKKEPGYTPLQEFMTRRPITVQAEASLSDVLYLLNRYQLSRLPVTEGHKLVGIITRTDIIRVEANQLQGDDTTINEVVPDPSYIAYQTRAPLAGDGRILLPLVNPDTATSLFKISSAIAQQQNQEIECLQVITVPKHSDPAQTPVITQHSRQLLQRTERLGRHYHIPVHTQIRVAHDRAQAILDTIRERHINLMVLEWTDDHHTPGTIFDPVIDILIRKATCELILVKLGQEKEAYPQILDKDTTWLIPIAGGPNAKRAMELLPGLTKLYTRPRSPIIWLCQVFPPHKSTPNYQALEIEAKRLKEELERPVIPLPVRSQSVADAIIHLAEAESCDVVMLGVSREGLLVQVMQGNIPKMIAQQVKSTVILVRGKLDN

SEQ ID NO: 61 - DNA, 2649 bp, Cyanothece sp.
atgcagcctcatttaatgcctcaacgtctttatcaatggttcaaatcaagaaactttgctcttaatgccacggacacccgttatgccttagtagaagcaagtttaattggagtgctttcagcgatcgcagccttgatcctcaaacaaggggtcggttggttaggaggttggcgtgttgccttagccaatgaattcggcggaatagtcgtgcttcccttgggaggacttattttaggctatttagccggttggatcatcgaaaccctgtcccccacagcgacaggaggcgggatcactcaagttaaagcagccttagcccgatatccggtgcctttatctttacgggtcgccatcgttaaattgattggaaccattttagtcttaggaggagggttaaccctcggccgtcgtgcgccaactgttcatattggggccgctttagcagcgcaactaagtagctgggttcctacctccccagaacatcgacgacaaatgatcgcagccggggcagcagcaggactcgcagccggttttaccacccccattgccggggttttatttgtcattgaagagttgatgcgggatgtgtcggggttaaccctagaaacggctattgtcgcctcttttactggggcagtggtgtctttaattttgcaatcgtctaccctcaatttgccctcctcattattagaactgcccgatattaccttttctgccttagatattcccttttatctgcttctaggcatcttagccggggtcttaggggctttatttaatcgaggactcctgctaagtgtcaaaatacaacatcagttcaatttacccttatcctggcgcattggtttaatgggaatggtttcaggtatcatcatcgcagtcctgcctcccttctttcgcgataatgcaggactgcggattattttggtcacgggggaattagattggagtcgcattttattggctttcgtcgctcattttttcctcaccattttggcctatagtgctaacacccctggagggttattcggtccagcactggtattgggatcggccttagggtatttagtgggagattttgagcaatttttgacaggaacgggtactcaatcgagttatgccttagccggaatgggggcgtttttcaccgcagtcgtcagggttccggtaacagcgatcgtctttgtctttgaactcaatacggatttcaatattgttttacccttgatggtgacttgtgctgtttcttatatcgtggctgagagtgtctcgcggggatctctctacgaacatatgttacacgctcgtgggatctatattaatgaagcggccacaggacaggattttctctccaaactcactgcgtctcaggtcatggagtctcacgttgaaactctatccagtgatttgtccttagatgaagtcctgcaagccatgtctaactctactcatcgggggtttcctgtggttgagcaaggtcaattagtcggcattgttacccagacggatctagctaaattgaagaaagtgccaggatatactcccttatcagaatttatgacccgacgacccattacggtacaagcagagtcctctttaagtgatgtgttataccttctcaaccgttatcaattgtcccgtcttcccgtaacagaaggccataaattagtcggaattattacccgaacagatattattcgcattgaagctaatcagttacaaggggatgataccaccatcaatgaggtggttcctgatccatcctatattgcctatcaaacacgggcccccttagctggtgagggtcgcattttattgccgttggttaaccccgatacggcaacctctctgtttaaaattagtgcagcgatcgctcaaaaacaaaaccaggaaatcgaatgtttacaggtgattaccgttcctaaacacagtgaccctgcccaaaccccggttattacccaacatagtcgtcaattattacaaagaaccgaacgattaggccgtcaatatcatcttcctgttcatactcaaattcgtattgcccacgatcgcgcccaagccattttagataccattcgagaacgacacatcgatctcatggttttacaatggaccgatgacaatcacagtccagggacgatttttgacccagtgattgatgttttaattcgtaaagctacttgcgaattagttctagttaaactaggtcaagaaaaagaagcgtatccccaaaccttagataaagatgccacttggttacttcccattgctggtggtcccaatgccaaacgagccatggaattgttacccggattaatcaaattatatactcgtcctcgttcccctattatttggttatgtcaggtattttctccccataaagctacccctaattatcaatccttagaagttgcagctaaacgtttaaaagaagaacttgaacgtcctgtgattccccttcctgttcgttctcagtctgtggccgatgccatcattcatttagccgaagcagaaacctgtgatgtggtcatgttgggggtgagtcgagaaggtttattagtgcaagtaatgcaaggtaatctgcctaaaatgatcgctcaacaggtgaaaagtacggtgattttagtgcgaggaaagttagataattag

SEQ ID NO: 62 - protein, 882 aa, Cyanothece sp.
MQPHLMPQRLYQWFKSRNFALNATDTRYALVEASLIGVLSAIAALILKQGVGWLGGWRVALANEFGGIVVLPLGGLILGYLAGWIIETLSPTATGGGITQVKAALARYPVPLSLRVAIVKLIGTILVLGGGLTLGRRAPTVHIGAALAAQLSSWVPTSPEHRRQMIAAGAAAGLAAGFTTPIAGVLFVIEELMRDVSGLTLETAIVASFTGAVVSLILQSSTLNLPSSLLELPDITFSALDIPFYLLLGILAGVLGALFNRGLLLSVKIQHQFNLPLSWRIGLMGMVSGIIIAVLPPFFRDNAGLRIILVTGELDWSRILLAFVAHFFLTILAYSANTPGGLFGPALVLGSALGYLVGDFEQFLTGTGTQSSYALAGMGAFFTAVVRVPVTAIVFVFELNTDFNIVLPLMVTCAVSYIVAESVSRGSLYEHMLHARGIYINEAATGQDFLSKLTASQVMESHVETLSSDLSLDEVLQAMSNSTHRGFPVVEQGQLVGIVTQTDLAKLKKVPGYTPLSEFMTRRPITVQAESSLSDVLYLLNRYQLSRLPVTEGHKLVGIITRTDIIRIEANQLQGDDTTINEVVPDPSYIAYQTRAPLAGEGRILLPLVNPDTATSLFKISAAIAQKQNQEIECLQVITVPKHSDPAQTPVITQHSRQLLQRTERLGRQYHLPVHTQIRIAHDRAQAILDTIRERHIDLMVLQWTDDNHSPGTIFDPVIDVLIRKATCELVLVKLGQEKEAYPQTLDKDATWLLPIAGGPNAKRAMELLPGLIKLYTRPRSPIIWLCQVFSPHKATPNYQSLEVAAKRLKEELERPVIPLPVRSQSVADAIIHLAEAETCDVVMLGVSREGLLVQVMQGNLPKMIAQQVKSTVILVRGKLDN

SEQ ID NO: 63 - DNA, 2640 bp, Cyanothece sp.
ctataaagctcctcgaactaaaataaccgtactatcaacctgtttagcgatcgccttgggaatattaccatgaatcacctgttctaagagtccctctcgactgacccccaacatgaccacatcgcaagtttcagccgccgctagatgaacgactgcatccgccaccgactgggaacgaatgggtaaaggaatcacaggccgagcaacggcatctttgacagcttgggcagtttgttcgagaacttggtagtcaggaagagcacccgcaggtggaaacaccttacaaagccaaataatcggcgatcgcggacgatcatacaatccagttaaccccggtaataattctagagcccgttgggcattgggtcccccggcgatgggaattaaccaagtcgcatccctgtttaaactgtcgggataacttggctcacggttgcccaatttaaccaaaactaactcacacggagctttacgaatcagtaaatccaccacatgaccaaaaatcgcccccggagtccccgtttctccattccattccatcaccattaaattgatatggcgttcacgaatcgtatctaaaatgccttgggcaatatcatgagcaaccctcacttgcgtatgaactggcagtttttgacgacggcctaagcgttccatgcgatggagtaaatggcgactatgttgcgacttaaccggggtttgggctggtttcttgtgtttaggaaccttaattacctgcaaacattctaattcgtcattttgttgcctagcgatcgctgctccaatttgaaacaaggccgttgccgttttggggtcagccaagggtaacaaaattcgtccccctcccgtggccggtgcacgggtttgataggcgatataggagggttctgggatggcttcattgagtttagaatcattcccctccagttgattcgcttcgacacggataatatcggtacgggtgatgattccgaccaacttacttccttcggtcacaggaagacgggacaactgataacggttcaataaatagagaacatcactcaataaagcatcagcttcgacgctaataggacggggagtcataaactgcttgacgggggtttgactcgacagcttggcagcgttggccacatcggtttgggtaacaatgcccactaatttaccttcttccatcaccggaaacccgcgatgactcgataaggacatagcttggatcacctgatctaaggttaagtcactgggtaaggtttccacctgagattgcatgacatcggctgccgtcaattgagagagaaaatcctgaacgacagggttattatccaggtaaatgccccgcgctttgagcattcgttcgtataaagacccccgtgaaaaactgtcggccaccacataggcaaccgaagaagtaaccattaacggcagaacgatattaaaattgctattcagttcaaaaacaatcacaatagccgtaacaggaacgccaactactgccgaaaaaaagccccccatccccgctaaggcaaaggctgattggctactacttcccatgatgaactgctccaaatcccccactaaatagcctaaggccgaacccaagactaaggccggggcaaataacccccctggagcattagaactataggccaacatggtcagaaaaaaatgggcaacaaaggctaagaaaattttctcggtactgagttcccccctcaccaagacagtctgaagtcgggtattatcttgaaaaaatgggggcaacagagcaataattaggccagaaatcattgcaactagcccaatacgccagggtaggggtaatttgagacgactttggatagctaaactgaacagtaacccttgtttaaagagagcccccaaaaaccctgcgagtatgcctaataataggtaaaagggaatatcgtccaccgaaaaactaatattcgggagattcaagaggggggcaaaagacagcgatcgcgcttcaacaattaacgagacgactgccccagtaaaggaggcaatgatggaggtttgcagcgttaaccctgagacatctcgcatcaactcttctacaacgaacaacacacctgcaattggggttccaaaaccggccgcgagtcctgccgccgcgccggccgcaatcatttgtcgacgatgttcaggggaagtaggaacccaactactcaactgtgccgctaaggctgcaccgacatgaacggttggggctcgccgaccgagggttaatcctcctcctaggactagaattgtgccaatgagtttaacgaccgctactcgcagggacaaaggcactggataacgggctaaggccgctttaacttgggtaataccgcctcctgcggcggtaggagaggtttgttcgattaaccatccagccatcgaacctaaaaagagtccccccaagggaagtacccaaattgctcccaattgattggctagactaacccgccatcctcctaaccagcctactccctcttttaatattaaggcagcgattcctgagagtaatcctagtaaacaagcttctacaaaggcatagcgagaatcagtggcatttactcccaagtggctagatttgacccattggtagaggcgtttaacgattaaatgaggcttcat

SEQ ID NO: 64 - protein, 879 aa, Cyanothece sp.
MKPHLIVKRLYQWVKSSHLGVNATDSRYAFVEACLLGLLSGIAALILKEGVGWLGGWRVSLANQLGAIWVLPLGGLFLGSMAGWLIEQTSPTAAGGGITQVKAALARYPVPLSLRVAVVKLIGTILVLGGGLTLGRRAPTVHVGAALAAQLSSWVPTSPEHRRQMIAAGAAAGLAAGFGTPIAGVLFVVEELMRDVSGLTLQTSIIASFTGAVVSLIVEARSLSFAPLLNLPNISFSVDDIPFYLLLGILAGFLGALFKQGLLFSLAIQSRLKLPLPWRIGLVAMISGLIIALLPPFFQDNTRLQTVLVRGELSTEKIFLAFVAHFFLTMLAYSSNAPGGLFAPALVLGSALGYLVGDLEQFIMGSSSQSAFALAGMGGFFSAVVGVPVTAIVIVFELNSNFNIVLPLMVTSSVAYVVADSFSRGSLYERMLKARGIYLDNNPVVQDFLSQLTAADVMQSQVETLPSDLTLDQVIQAMSLSSHRGFPVMEEGKLVGIVTQTDVANAAKLSSQTPVKQFMTPRPISVEADALLSDVLYLLNRYQLSRLPVTEGSKLVGIITRTDIIRVEANQLEGNDSKLNEAIPEPSYIAYQTRAPATGGGRILLPLADPKTATALFQIGAAIARQQNDELECLQVIKVPKHKKPAQTPVKSQHSRHLLHRMERLGRRQKLPVHTQVRVAHDIAQGILDTIRERHINLMVMEWNGETGTPGAIFGHVVDLLIRKAPCELVLVKLGNREPSYPDSLNRDATWLIPIAGGPNAQRALELLPGLTGLYDRPRSPIIWLCKVFPPAGALPDYQVLEQTAQAVKDAVARPVIPLPIRSQSVADAVVHLAAAETCDVVMLGVSREGLLEQVIHGNIPKAIAKQVDSTVILVRGAL

SEQ ID NO: 65 - DNA, 2649 bp, Crocosphaera watsonii
ctaattgtccaactttcctctcactaaaatcatggtacttttgacctgctgggcgatggttttaggaatattgccctgcattacttgagctaataacccttctttactcacccccaacataaccacatcacagctttcggactcggccaaatgaacgatcgcatcagtgacagactgggaacgaatgggaaggggaattacagggcgttccagttgttcttttaattgttgtgccttagcttctaaagattgatagtcaggagtcggtttatggggagaaaacacctgacataaccaaataatgggggaacggggacgagtatataattgggttaatcctggtaataattccatggcccgtttagcattgggaccaccagcaataggaatcaaccaagtggtatctttatctaaagtttgggggtaagcttctttttctttgcccaacttaactataactaactcacaagtggccctacgaattaaaatatcaatcaccggcccaaaaacactaccaggagtctttttgtctgggttccattctaagactatgagattgatatgtcgttctcgaatggtgtctaaaatagcttgggcgcgatcgtgagcaacacgaatttgagtgtgaacagaaatctggtgttgacggcctaatctttctgctctttgtaataattgacgactctgttgggtgattacagtggtttgtgccggatcgctatgtttagggatcttaattacctgtaaacattcgatttcttggttttgttgttcggcgatcgctgcactaattttaaacaaagaagttgctgtatttatgtttgtcaggggtaacaaaatgcgtcccactcccactaaaggggcgcgggtttgataagcaatataggagggatcggggaccacttcattaatagtcgtatcatccccttgtaactggttggcttcgatgcgaataatatcggttcgggtgataattcctactaatttatgcccttctgtcacaggtagacgggaaagttgataacggttaagtaggtataaaacatcgcttaaagaagcctctgcttgtactgtaatgggttttcgagtcatgaattcccataaaggggtgtatcctggcactttcttcaattttgccagatcagtttgagtgacaatacccactaattgaccttcggccagcaccggaaaccctcgatgactcgaagccgacatcgcttgtagtacgtcatctaaagtgaagtcgctggataaggtttccacctgagactgcattacttctgaagcggttaatttagagagaaaatcctgtcctgtagccccttcattgatatagatccccctagcctttaacatatgttcgtagagagaacccttggagacactttcggccacgatataagaaacagcacaagtaaccattaagggtaaaacaatattaaagttcgtatttagttcaaagacaaagacgatcgccgttaccggaaccctaacaactgctgtgaaaaatgctcccattcctgccagtgcataggtagtctctgtgccggtgccagttaataattcttcaaaatctcccactagataccctaaagcagatcccaacaccagcgccggaccgaataaaccgccgggggtattggcactataggccaaaatagtcaggaaaaaatgagctacaaaagccaataaaatgcgactccattctaattctccttgtactaaatcaatacgcagtcctgtattatctcgaaagaaagggggtagtatggcaataattagacccgaagccatgcccattaagccaatacgccaggataaaggtaaattaagatatttttgtattttgacgctgagtaatagtccccgattaaataaagcccctaagatccctgctaatattcccagtagtaggtaaaagggaatttctgaggcggagaaagcaatatcaggcagatccaacaaagaggagggaaaattgaaggtagaagattgcaaaatttgggagacaactgctccggtaaaagaggccacgatcgccgtttctagggttaacccagaaacatctcgcattaactcttcaatgacgaataacaccccggcgatgggggtggtaaaaccggccgctagtccggctgctgccccggctgcgatcatttgtcgtcgatgttccggggaagtgggaacccaactactcagttgcgctgctaaggctgccccaatgtgtacagtaggcgcacgacggcctagggttaagccgccccctagcaccaaaatggttccgattaatttaaccagtgctacccgtagagagaggggaactggataccgggctaaagcggcttttacttgagtcatcccgccccctgtagctgtgggggagagggtttctatgagccaaccggccatggaacctaaaattagtcctcccaagggtagcacccatattgcaccaaattgattggccaaggccacacgcttaccccctaaccaacctactccttgtttgagaattaaggctgcgatcgccgataaaatcccaattaaacaggcttctgctaaggcataacgggtgtcagtggcatcaacagtacgcagtcttgattttaaccagcgataaaaacgttgaaatattaaatgaggccccat

SEQ ID NO: 66 - protein, 882 aa, Crocosphaera watsonii
MGPHLIFQRFYRWLKSRLRTVDATDTRYALAEACLIGILSAIAALILKQGVGWLGGKRVALANQFGAIWVLPLGGLILGSMAGWLIETLSPTATGGGMTQVKAALARYPVPLSLRVALVKLIGTILVLGGGLTLGRRAPTVHIGAALAAQLSSWVPTSPEHRRQMIAAGAAAGLAAGFTTPIAGVLFVIEELMRDVSGLTLETAIVASFTGAVVSQILQSSTFNFPSSLLDLPDIAFSASEIPFYLLLGILAGILGALFNRGLLLSVKIQKYLNLPLSWRIGLMGMASGLIIAILPPFFRDNTGLRIDLVQGELEWSRILLAFVAHFFLTILAYSANTPGGLFGPALVLGSALGYLVGDFEELLTGTGTETTYALAGMGAFFTAVVRVPVTAIVFVFELNTNFNIVLPLMVTCAVSYIVAESVSKGSLYEHMLKARGIYINEGATGQDFLSKLTASEVMQSQVETLSSDFTLDDVLQAMSASSHRGFPVLAEGQLVGIVTQTDLAKLKKVPGYTPLWEFMTRKPITVQAEASLSDVLYLLNRYQLSRLPVTEGHKLVGIITRTDIIRIEANQLQGDDTTINEVVPDPSYIAYQTRAPLVGVGRILLPLTNINTATSLFKISAAIAEQQNQEIECLQVIKIPKHSDPAQTTVITQQSRQLLQRAERLGRQHQISVHTQIRVAHDRAQAILDTIRERHINLIVLEWNPDKKTPGSVFGPVIDILIRRATCELVIVKLGKEKEAYPQTLDKDTTWLIPIAGGPNAKRAMELLPGLTQLYTRPRSPIIWLCQVFSPHKPTPDYQSLEAKAQQLKEQLERPVIPLPIRSQSVTDAIVHLAESESCDVVMLGVSKEGLLAQVMQGNIPKTIAQQVKSTMILVRGKLDN

SEQ ID NO: 67 - DNA, 2628 bp, Microcystus aeruginosa
ctaatctgataattcccctcgcacgagaatcacagtgcaattaaccgcacgggcaatcgtcgaggggatattgccatttaagaactgattgagcaagctttccctagatgcacccaaaagcaccaacgaacagtcttccgattctaccagattaattattgcctcggccggagaggccgaacgaatcggtaaaggcacaatcggctgtgcgatcgctttctgtaaagatgcttgtaaaacttccaaaatagacagatctggcagtaaatccgtcggagaatagattttacataaccaaagtttgggataatccgaagactcggacaaagacaacaaactaggcaataatgctaaagcgcgttgggcattaggaccgccggcggtgggaatcagccaaatcctttcccgattaggatcattgggaaaacaatcctttgtccccaattttaccaagatggtttcacagggagcttgggcgatcaaagtatcgactaaaaacccaaaaatcgccccagtagtggatctttcccccgtccaacccataattaataaattgctgtgtcgttcgcgaatcgtggccaaaatcccttcggcgatatcctgagccaccgaaatttgtgtatgaacagagatattctgctgtcgcgctaatctttccagacgatgaagtaatttgcgtccttcccgcgtatctacctttacttccgccggagaactaagacgaggtacagtaatcacatagagacaatctatctcataattgcgttcacgggcgacagcagcagcaattttaaacaaagcggtagcggtgtcgggattggcaatgggtaacaaaatccggcctattcccacagccggagaacgagtttgataaaccacataggaaggggtagtgggttgaggcagttgacaaaccccccccaattgatcagcttccacccggataatatcggtgcgggtgatgatccccaccagtttttgaccatcggtaacgggtaaacgggaaagctgatagcgatttaacagaaataaaacatcgcttaaggctgcctggggagccaccgtaatcggattgggagtcatcatctcccgtaggacggtttgactgttttttgatcgccatttatccagatcactttgggtaaaaatccccaatagtcgcccctgttccaccacgggaaaaccgcgatgatgggaacgggacataattttcaccacttcccccaggggtaaatccgccgccagaatttccacctgcgattgcatcacatccatagccgatagatgggccagcacatcattagcaggggtttcctcgttgagaataataccactagcggaaagtaaatgctcatagagggaaccggggcgaatgctttcggcagtaatataagaaacggcacaggtcaacatcaggggcagcacaatattaaaattgcgatgcagttcaaagacaatcacgatcgccgttaccggaaccctgactactcccgtaaaaaaggcccccataccggctaaagcataactaggttcgctgccgaaacccataattttcgtctcgattccccccaccagaaaccccaaacaggatcccaacaccaaagcgggggcgagcagtcctccaggagcgccggaactataggagatcatcgtcaggaaaaaatagaccacaaaagcgagggcggtattctgccaacttaattcccctgccagcaaaaattcgcgtaaacccgtattatctcgaaaaaagtcgggtaaaaaagccactaccgttcccgataggccactgaccagaccgatgcgccaagctaaagataaccgccaacgccgctgcatctggctacaaaaaaggatgccttgattgaataaagcccccaataagcccgctaaaacccccaaaaggcaataaatgggtatttcttgggcagagaagctaatattggcatattcagtgatgatcgagggggtattctgcagcatcatcgaaaccacggccccggtaaaggaagccacgatcgccgtttctagggtcatactggaaacatcgcgcattaattcctcgatcacaaagaggactccggcgatgggcgtagtaaaaccggccgctaacccggcggctgccccggctgcgatcatctgacgacggtgatcgggactggtgggcagccagacgcttaactgggccgccagggctgccccgatgtgtaccgtgggggcccgacgaccaagggttaaaccaccgccaaggatcaggatcgccccgatcatttttacgacggcaacgcgccaagacaggggcaaagggtatttagctagggctgcttttacttggggaataccccccccggcggctgcgggggagaagtgttccacaatccagccggcgctataaccaagcagaaaaccgccgaggggcaaaactaggaaaggagaggaattggctactagatgcacccgccaaccacctaaccaaccgatgcccaatttcaggataatagcggcaagggcggagagaattccgattaaacaggcgaccagtaaagcatagcgactatcggtggcgctacgtccgaagtgttgggatttaaaccactgacggaggttttggtaacgggcaaaaagtcccat

SEQ ID NO: 68 - protein, 875 aa, Microcystus aeruginosa
MGLFARYQNLRQWFKSQHFGRSATDSRYALLVACLIGILSALAAIILKLGIGWLGGWRVHLVANSSPFLVLPLGGFLLGYSAGWIVEHFSPAAAGGGIPQVKAALAKYPLPLSWRVAVVKMIGAILILGGGLTLGRRAPTVHIGAALAAQLSVWLPTSPDHRRQMIAAGAAAGLAAGFTTPIAGVLFVIEELMRDVSSMTLETAIVASFTGAVVSMMLQNTPSIITEYANISFSAQEIPIYCLLGVLAGLLGALFNQGILFCSQMQRRWRLSLAWRIGLVSGLSGTVVAFLPDFFRDNTGLREFLLAGELSWQNTALAFVVYFFLTMISYSSGAPGGLLAPALVLGSCLGFLVGGIETKIMGFGSEPSYALAGMGAFFTGVVRVPVTAIVIVFELHRNFNIVLPLMLTCAVSYITAESIRPGSLYEHLLSASGIILNEETPANDVLAHLSAMDVMQSQVEILAADLPLGEVVKIMSRSHHRGFPVVEQGRLLGIFTQSDLDKWRSKNSQTVLREMMTPNPITVAPQAALSDVLFLLNRYQLSRLPVTDGQKLVGIITRTDIIRVEADQLGGVCQLPQPTTPSYVVYQTRSPAVGIGRILLPIANPDTATALFKIAAAVARERNYEIDCLYVITVPRLSSPAEVKVDTREGRKLLHRLERLARQQNISVHTQISVAQDIAEGILATIRERHSNLLIMGWTGERSTTGAIFGFLVDTLIAQAPCETILVKLGTKDCFPNDPNRERIWLIPTAGGPNAQRALALLPSLLSLSESSDYPKLWLCKIYSPTDLLPDLSILEVLQASLQKAIAQPIVPLPIRSASPAEAIINLVESEDCSLVLLGASRESLLNQFLNGNIPSTIARAVNCTVILVRGELSD

SEQ ID NO: 69 - DNA, 2628 bp, Microcystus aeruginosa
ctaatctgataattcccctcgcacgagaatcacagtgcaattaacggcacgggcaatcgtcgaggggatattgccatttaataactgattgagcagactctctctagatgcacccaaaagcaccaaggaacaatcttccgattctaccagattaattaccgcctcggccggagaggccgaacgaatcggtaaaggcacgactggctgtgcgatcgctttttgtaaagatgcttgtaaaacttccaaagtggacagatctggcagtaactccgtcggagaataaattttacataaccaaagttcgggatgatccgaagactcggacaaagacagcaaactaggcaataatgctaaagctcgttgagcattgggacctccggcagtgggaatcagccaaatcctttcccgattaagatcgttgggaaaacaatcctttgtccccaattttaccaagatggtttcacagggagcctcagcgatcaaagtatcgactgaaaacccgaaaatcgccccagtagtggatttttcccccgtccaacccataattaataaattgctgtgtcgttcgcgaatcgtggctaaaatcccgtcggcgatatcctgagccacagaaatttgtgtatgaacagagatatgctgctgtcgggctaatctttccagacgatgaagtaatttgcgtccttcccgtgtatctacctttacttccgccggagaactaagacgaggcacagtaatcacatagagacaatctatctcataattgcgttcactggcgatcgcagcagcaattttaaacaaagcagtagcggtgtcaggattggcaataggtaataaaatccggcctattcccacagctggggaacgagtttgataaaccacataggaaggggtactgggttggggcagttgacaaactccccccaattgatcggcttccacccgaataatatcggtgcgggtgatgatccccaccagtttttgaccgtcggtaacgggtaaacgggaaagctgatagcgatttaagagaaataaaacatcggttaaagctgcctggggggccacagtaatcggattgggagtcatgatctcccgtaggactgtttgactgttttttgatcgccatttatccagatcactttgggtaaaaatccccaatagtcgcccctgttccaccacgggaaaaccgcgatgatgggaacgggacataattttcaccacttcccccaggggtaaatccgccggcagaatttccacctgcgattgcatcacatccatagccgacagatgggccaacacatcattagaaggggtttcttcgttgagaataataccactagcggaaagtaaatgctgatagagggaaccggggtgaatgctttcggcagtgatataagaaacggcacaggtcaacatcaggggcagcacaatattaaaattgcgatgcagttcaaagacaatcacgatcgccgttaccggaaccctgactactcccgtaaaaaaagcccccataccggctaaagtataactaggttcgctgccgaaacccatcattttcgtctcgattccccccaccagaaaccccaagcaggatcccaacaccaaagcgggggcgaggagtcctcccggagcgccggaactataggagatcatcgtcaggaaaaaatagaccacaaaagcgagggcggtattctgccaacttaattcccctgccagcaaaaattcgcgtaaacccgtattatcccgaaaaaagtcgggtaaaaaggccactaccgttcccgataaccagctgaccagaccgatgcgccaagccagagataaccgccaacgccgctgcagctggctacaaaaaaggatgccttgattgaataaagcccccaataagcccgctaaaacccccaaaaggcaataaatgggtatttcttgggcagagaagctaatattggcatattcagtgatgatcgagggggtattctgcagcatcatcgaaaccacggccccggtaaaggaagccacaatcgccgtttctagggtcatactggagacatcgcgcattaattcctcgatcacaaagaggacgccggcgatgggagtagtaaaaccggcggctaaccccgcggctgccccggctgcgatcatctgacgacggtgatcgggactggtgggcagccagacgcttaattgggccgctagggctgctccgatgtgtaccgtaggggcgcgacgaccaagggttaaaccaccgccaaggatcaggatcgccccgatcatttttactagggcgacccgccaagacaggggcaaaggatatttagctaaggccgcttttacttggggaataccacccccggcggccgcgggggagaagtgttcgacaatccaaccggcactgtaaccgagcagaaaaccgccgaggggcaaaactaggaaaggagaggaattggctactagatgcacccgccaaccacctaaccaaccgatacccaatttcaggataatagcggcaagggcggagagaattccgattaaacaggctaccagtaaagcatagcgactatcggttgcgctacgtccgaagtgttgggatttaaaccactgacggaggttttggtgacgggcaaaaagtcccat

SEQ ID NO: 70 - protein, 875 aa, Microcystus aeruginosa
MGLFARHQNLRQWFKSQHFGRSATDSRYALLVACLIGILSALAAIILKLGIGWLGGWRVHLVANSSPFLVLPLGGFLLGYSAGWIVEHFSPAAAGGGIPQVKAALAKYPLPLSWRVALVKMIGAILILGGGLTLGRRAPTVHIGAALAAQLSVWLPTSPDHRRQMIAAGAAAGLAAGFTTPIAGVLFVIEELMRDVSSMTLETAIVASFTGAVVSMMLQNTPSIITEYANISFSAQEIPIYCLLGVLAGLLGALFNQGILFCSQLQRRWRLSLAWRIGLVSWLSGTVVAFLPDFFRDNTGLREFLLAGELSWQNTALAFVVYFFLTMISYSSGAPGGLLAPALVLGSCLGFLVGGIETKMMGFGSEPSYTLAGMGAFFTGVVRVPVTAIVIVFELHRNFNIVLPLMLTCAVSYITAESIHPGSLYQHLLSASGIILNEETPSNDVLAHLSAMDVMQSQVEILPADLPLGEVVKIMSRSHHRGFPVVEQGRLLGIFTQSDLDKWRSKNSQTVLREIMTPNPITVAPQAALTDVLFLLNRYQLSRLPVTDGQKLVGIITRTDIIRVEADQLGGVCQLPQPSTPSYVVYQTRSPAVGIGRILLPIANPDTATALFKIAAAIASERNYEIDCLYVITVPRLSSPAEVKVDTREGRKLLHRLERLARQQHISVHTQISVAQDIADGILATIRERHSNLLIMGWTGEKSTTGAIFGFSVDTLIAEAPCETILVKLGTKDCFPNDLNRERIWLIPTAGGPNAQRALALLPSLLSLSESSDHPELWLCKIYSPTELLPDLSTLEVLQASLQKAIAQPVVPLPIRSASPAEAVINLVESEDCSLVLLGASRESLLNQLLNGNIPSTIARAVNCTVILVRGELSD

SEQ ID NO: 71 - DNA, 2637 bp, Synechocystis sp.
tcattcggggtcagtgacgtctaaggccccccgaataatcaccactgtgcggtttgtccccttggcgatcgcctccgggatatttccatggagcgccttttgaaataagctttctcggctagctcccagaatgaccagatcgtaggtttcttctttgattaggcggattaaactgtcagcaatgtgggacgagcgaataggtaggggaataatgggaatttcgaccaggggatccaagcctcgcttggccttgacgagcagcggaaaatgttgggggcgttgttggggttgatagacctgacagaggcaaatttgggacggcagggaatagcgcaccacctctggggacaggtgcagcagtgctgggatgaattcctgggcgcgttcggcgttggggccgcccgcaatgggaacgagggcgcggatttttcctgtttgagccttaaattggaggggatgggcgtggctcgttttcaccaaaatcacgtcacagggcacttttttcacgagatattccattacactcccgaacagttgcccccctgggtggcgatcgccttgccaacccaagattaacccctgatccttgctcgaaatttcctgaagaatggccccggccacatcgtaggcgaggatcacttgggtgtggattgagatccccaatgtctccccaaggcgttccagtttttccatcagatgccgttctggataggtgttcatgtgggcatcggtgaggggataggttgctgccacctgcaccacattcaggcaatagaccatggcatttttttccttggcaatggctgccgcaaaggtgatgagggcttcggcggtattgggattggcgatcgccacccagagtttgcgcttgtaattgtcgctggtgtgggtttgataaacgcaataggacggcgtgcgctgtactgcatggtgacttttcccgaggagttcctgggcctcggcacgaataatatctgaccgggtaataatcccctggagctgatcattatcgacgacaggtaggcgggaaatttgataacgattgagcaggtacaaaacatcactaagggaagcccggggagagaccgtaatcaccttgcgttgcatcacctgggctaccgttaaattctttccctgggccgccatttgggccagatccccttgggtgacaatgccgacgagcttgccttgttttaaaaccggaaaaccccggtggggcgattcagacaggatggggactaaatcctttaagttgaggtggctttccagggtttctacttccggttgcatcacctgggcggcggtgagatccgttaacacctgggggtttttttcctcctctaggtgaatgccgctggcttccaggagatactcgtagatcgaacctttaaaaatgctttcggccacgatgagcgctgtcaccgaagccagcattaaggggaggactaaattaaaatctgtggtcagctcaaagacaattacaatcgcggtcactggcacccgcgccacccctgtaaaaaaagcccccatccccgcaagggcgtaggtatattgggtcgcctctggcacaaagatctcggcacaggtacccactaaataaccgagggccgtgcctaaaacgagggtcggtgcaaatagtccccccggtgcgccggagccataggcaatcaagcttaggaaaaagtgggcgacaaaggcgatcgcaattacctgccagcccgcatcccccgtaagcaaaaaatcccgtagccctgcattgtcccggaaaaaaggcggcaaaaacgcgaccacagtgcccgaaatcgccccggcgatcgccatccgcacccccaagctcaaacggagacgacgattaaaccccaaaaccgttaagataccgcgattgaataaagcccccaaaacccctgccaagccccccaacagcaaataccaggggatttctgccagataaaaattactttgattcgccgcgtttaatagctctgcgggcaaattcagatccgaagtgccaaaccagcgggagaccaccgcgcccgtaaaggaagcaacaattgctgtttctaaagtcagccctgacatgtcccgcatcagttcttcgaccacgaacagtaccccagcaatgggggtattaaatcccgccgctaaacccgccgctgctccggctgcaatcatctgtcgtcggtggtttggggttgtcggcagccattgactgagttgagctgcgagagccgcaccgatatggacactggggccgcgccgtccgagggtcagtccaccacctagaaccaaaatcgtgccaatggatttagctaaggctaccttccaatttagcggcaggggaaattgggccaggacaaccttgacctgggggacgccgccccccttggcttctggggcaaaggtctctaggagatagcccgccaaccagccgcaaaccaccccaaacagaggcaggattaaccaggcgccgtattgacgactcaggatgacccgatatccccccacgaaaccaatgccttgtttgaggaaaagggccgccaaaccggagatgacaccaatgaggcaggcttcgattaataaatagttattgtttaagctgtgctggcctaaggatcgaaaaatccaccaatttcgcac

SEQ ID NO: 72 - protein, 878 aa, Synechocystis sp.
MRNWWIFRSLGQHSLNNNYLLIEACLIGVISGLAALFLKQGIGFVGGYRVILSRQYGAWLILPLFGVVCGWLAGYLLETFAPEAKGGGVPQVKVVLAQFPLPLNWKVALAKSIGTILVLGGGLTLGRRGPSVHIGAALAAQLSQWLPTTPNHRRQMIAAGAAAGLAAGFNTPIAGVLFVVEELMRDMSGLTLETAIVASFTGAVVSRWFGTSDLNLPAELLNAANQSNFYLAEIPWYLLLGGLAGVLGALFNRGILTVLGFNRRLRLSLGVRMAIAGAISGTVVAFLPPFFRDNAGLRDFLLTGDAGWQVIAIAFVAHFFLSLIAYGSGAPGGLFAPTLVLGTALGYLVGTCAEIFVPEATQYTYALAGMGAFFTGVARVPVTAIVIVFELTTDFNLVLPLMLASVTALIVAESIFKGSIYEYLLEASGIHLEEEKNPQVLTDLTAAQVMQPEVETLESHLNLKDLVPILSESPHRGFPVLKQGKLVGIVTQGDLAQMAAQGKNLTVAQVMQRKVITVSPRASLSDVLYLLNRYQISRLPVVDNDQLQGIITRSDIIRAEAQELLGKSHHAVQRTPSYCVYQTHTSDNYKRKLWVAIANPNTAEALITFAAAIAKEKNAMVYCLNVVQVAATYPLTDAHMNTYPERHLMEKLERLGETLGISIHTQVILAYDVAGAILQEISSKDQGLILGWQGDRHPGGQLFGSVMEYLVKKVPCDVILVKTSHAHPLQFKAQTGKIRALVPIAGGPNAERAQEFIPALLHLSPEVVRYSLPSQICLCQVYQPQQRPQHFPLLVKAKRGLDPLVEIPIIPLPIRSSHIADSLIRLIKEETYDLVILGASRESLFQKALHGNIPEAIAKGTNRTVVIIRGALDVTDPE

SEQ ID NO: 73 - DNA, 2664 bp, Nodularia spumigena
atggcgatttctggtctgactcagcgctttcgcctttggttgcaaccgacaagaggtttagcgatcgccgaagcttgtattattggacttgtagccgccctttctgcggtgttcctgaaattcggctcaggatttttaggaacatggcgagtccaaactagccaaattgtaccagcattgttagtcttacctaccattggtctgagctttggatttatagctggctctttggtgaatagatttgcaccagaagcttcagggagcggtatccctcaagtcaaagccactcttgctaacgtcccaattacattatcctggcgagtggcaacggtaaagttaatcagtgctattatcaccctcggttcaggaatggctctggggcgacaaggccccaccgttcatgtaggggcgggtttagcagcaggaatgagtcgctgggttcccacctccccagatcatcgacgacagatgattgctgcgggtgctggtgcgggtttagcggccgctttcaatgccccaatcactggtgtattgtttatcgtagaggaattactccaagatttatcagggctgactttaggaaccgccattatcgcttcctttattggtggtgtagtatctcggctgttgggtgggggtagtttgcaacttaacctggaattgttgcaatacgccagtaacttcactttgccagaaattcccttttttgtcttgttggggattttagcagggttcctgggtgcattatttaatcgtggtttaatcgccagtattaaaatttatcaaaatttacacctcagcttaccgctaaaaatggctttagctggatgtatttccggtttattagtggcaatgcttccggaatctttccgtgattatgcgggcttacgggagtacatgattatcagtgaagctaatataacttttgcggcgatcgcctttttatctcaatttctgctcaccctggtggcctttggttccggtgcgcctggggggttatttgcgccgagtctgattttgggttcttgtttaggacatctagttggtgtatccgcctcttatttcttagcagtggattcccccacaacttacgctttagctggtatgggcggtttttttagtgctgtttctaaagtaccaatcacagccatagtaattgtctttgaaatgactacagatttcaatttggtactacctttgatgattgtatctgtagctgcatacttggtttcggacaaagtaatgccgggatctttatatgacaaactattacagctaaaaggcatcacaattactaaagctgtttcccccgaaggaatattaacaaagttaacagctaacgatgtcatgcagcatcgagtcgaaactctggatgcagatatgacattagaagaagcaatgcaagtattttcccgttcccatcatcggggctttccagtggtagagaatggcaaactcatcgggattatcacacaatcggattttgtcaccaaacgcgatagtgattcctacatcctgagtaatagccagtcaccaaaggatgtctcattaagggagattatgatccactcccccataactgtcaaacccaagcatcacctcagtaatgttttgtatttgctagatcgctatcaaattagtcgcttaccagtggtggaagggcggaaattagtggggattattacccgtgcagacatcatccgcgcccaagctgaacatttgaattatggcaacgttaccccagaatcacagccggaaccttcttatgtagtttatcaaacgcgatcgcctaatattggcagaggtcgattattagtaccagtagccaatcccgaaaccgccgccattctcttgcaaatggccgcagctattgcgcgcgatcgccactatgaaatcgagtgtgtgcaaataatcttagtatcgcgtcacaattccccctcagaaacatcagtcagaaccgccaaaagtcgccgcttactacgacaagccgaagttttggctaaaaagtggaaaattcccttacacacccaaattagagtcgcccacgacccagccgaggcaatattggaaaccatccacgaacgacatataaacctgattttaatgggctggaaaggtgaaacttctacccctgggcggatttttggcaatgttgtagataccatcattcgtcaagccacctgcgacgtaatgctagtaaaactgggtaatactccccactccctactccccattccccattccccattccccactcccaaattcaaccgttggctagtcacaatggctggcggtcctaatgtcagagtagcgattaaattattacctgctttagcgacattgggggataatccatacattcggctgacgcaggtgtttaaaccatctcagttaaagccagacatgacagttttagaacaagccatccggatattaatgcgtcgccgtaaattatccagcaatgtagttgctatccccgtccaagctgattcggtggctgaaggagtgattaatctcgtgaaaaccgaaggttatgatgttgtggttttaggggcttctcgtgagggattattacagcaagcagttcaaggtaatattcccgaagcgatcgcctctggtgtagactgcacagtcatcttagtcagaggcgcgattagtagttaa

SEQ ID NO: 74 - protein, 887 aa, Nodularia spumigena
MAISGLTQRFRLWLQPTRGLAIAEACIIGLVAALSAVFLKFGSGFLGTWRVQTSQIVPALLVLPTIGLSFGFIAGSLVNRFAPEASGSGIPQVKATLANVPITLSWRVATVKLISAIITLGSGMALGRQGPTVHVGAGLAAGMSRWVPTSPDHRRQMIAAGAGAGLAAAFNAPITGVLFIVEELLQDLSGLTLGTAIIASFIGGVVSRLLGGGSLQLNLELLQYASNFTLPEIPFFVLLGILAGFLGALFNRGLIASIKIYQNLHLSLPLKMALAGCISGLLVAMLPESFRDYAGLREYMIISEANITFAAIAFLSQFLLTLVAFGSGAPGGLFAPSLILGSCLGHLVGVSASYFLAVDSPTTYALAGMGGFFSAVSKVPITAIVIVFEMTTDFNLVLPLMIVSVAAYLVSDKVMPGSLYDKLLQLKGITITKAVSPEGILTKLTANDVMQHRVETLDADMTLEEAMQVFSRSHHRGFPVVENGKLIGIITQSDFVTKRDSDSYILSNSQSPKDVSLREIMIHSPITVKPKHHLSNVLYLLDRYQISRLPVVEGRKLVGIITRADIIRAQAEHLNYGNVTPESQPEPSYVVYQTRSPNIGRGRLLVPVANPETAAILLQMAAAIARDRHYEIECVQIILVSRHNSPSETSVRTAKSRRLLRQAEVLAKKWKIPLHTQIRVAHDPAEAILETIHERHINLILMGWKGETSTPGRIFGNVVDTIIRQATCDVMLVKLGNTPHSLLPIPHSPFPTPKFNRWLVTMAGGPNVRVAIKLLPALATLGDNPYIRLTQVFKPSQLKPDMTVLEQAIRILMRRRKLSSNVVAIPVQADSVAEGVINLVKTEGYDVVVLGASREGLLQQAVQGNIPEAIASGVDCTVILVRGAISS

SEQ ID NO: 75 - DNA, 2616 bp, Microcoleus chthonoplastes
ttatgtcgcactgcgaactaaaataacggtactcttcacccgccgcgcgatcgcttccggtatattctcctgaatcatgagctgtaatagcccttcccgacttgcgcctaaaaccacgacatcgcataattggttattagcgatataaaccaccgcatcagaaacctcactggcgcgaataggaatccggcgaatccgaccctcggtttgtttctttaaaaagtcgctagcttcttctatggcggttgtatccataatcgtatcttctggatcaaagacttggcataatcgaatatcgggtggcttactacttaagggaattaacgctggcagaaattccaaagcgcgttgcgaattcggaccgcctgcgatgggaatcaaccaacgctgaaagaagggagggatataaggcggatgcatcatttcacccaatttaacgaccatcacatcacagggcgcttgtcgaatcactgcatccactaccccgccaaaaatgcgtccaggggttgaggttgagcctttccaccccatcatcatcaaattaatatgtcgctctttaatggtgtctagaatcccttgagtaatatcctgactcacccgtatttgagtgtgaacgggtatattccaatctcgtccccacttttccgcctgacgtaataaccgacgactttttgtggttgttactggcgtttctgcaggagacgtgctgcgggagacgagaatcacttgtagacattccaattcatagtcgcgatcgcgggcgatggcggcggcgagtttgactaatatgggggcggtttggggattagcgatgggaactaataaccgtcctcgtcccgtttctggcgatcgggtttgataaactacataagagggttctgattgtgatctagtctgagttgtcttactatcaagctgatccaattccgcccgaataatatcgctgcgggtaataattcccaataacttccgcccttcagtgactgggaggcgactgaggtgataacggttgagcagataaagcacatcgactaaactcgctgtcggcttcaccgttatcgggtgcgatgtcataatctctgctagaggtgtggtgccgggaaacggacaacggggcggattgccttgcatttttgtcgcctgtgtaagatctgattgactaataatccccactagcgtcccttcatctaccacaggaaacccttggtgcgtcgaacgagataccatctgcaaggcgtcatccagagtcatgtgcagcgataaggtttctacctgtcgttgcatcaaatcctctgctgttaacccaaccaatgaacccttgtctactttttgagtgggggaggtataccctctccattccaacagacgctgataaagtgagcctttggagagttgatcggcaattagataagacaccacacaggtgatcattaacggtaaaaccagattgaaatccgccgtaatctcaaatatgatcacaatcgcggttataggaaccttagatacagcactaaaaaacgcccccatccctgccaaggcgtaagtcgtcggttccccaacccctaaaaacgataatttagcaacgcccaccagataacccaaggcagaacccaaaaccagtgacgggtgaaataaacccccaggagcgcctgatccataagaaactagggtgagaaaaaagtaggttactaaagcgaggctagtgaattgccaactttctgcgcctgtaattaacaactcccgcaacccacgattattgcgaaaatccgggggtaacagagaaaccacacaaccacagattaatcccgctagccccatttttaccgccaaagagacatgaaagcggcgttgtagcgtcaatgaaaacagaatcccacgattaaataaggttgccagtaatccggctaaaagacccaggattaaataaaagggaatctccggagcagaaaaactactggttgtttgagttagttccaggttcaggtcgagactacgaccccctaaaatccgggaaatcaccgcaccgataaacgaagcgagaatcgctgttcctagcgttaagccggaaaaatcatggattaattcctcaaccacaaacaaaatacccgcgattggggtattaaaccccgccgctaaacccgccgctgaacccgccgcaatgagctggcgtcgatggctcggagaggtaggaaaccaacggctaaactgagccgctaacgctgcaccaatatgaactgtgggtccttgacgtcccagggtcagtcctgccgcgatcgctaaaatactactgacgagtttaaccagcgctacacgcaaatctagagcgatgggataccctccaagtgcggctttaatctgaggaataccactcccagaagcatcgggtgccaaatactcaaccaagaatccagacagtgctcccaataccagtccgaaagcgggtaaaactagaaagggcggaaattgttcagaagtttgaacccgccatgaaccgagccaaccaatactgtgttggagtaacacggcggatagcgcagaaaccaccccaattaaacaagcttctgcgatcgccaaacgtcgcttgggcagtaaccattgacgtatgggattgatcat

SEQ ID NO: 76 - protein, 871 aa, Microcoleus chthonoplastes
MINPIRQWLLPKRRLAIAEACLIGVVSALSAVLLQHSIGWLGSWRVQTSEQFPPFLVLPAFGLVLGALSGFLVEYLAPDASGSGIPQIKAALGGYPIALDLRVALVKLVSSILAIAAGLTLGRQGPTVHIGAALAAQFSRWFPTSPSHRRQLIAAGSAAGLAAGFNTPIAGILFVVEELIHDFSGLTLGTAILASFIGAVISRILGGRSLDLNLELTQTTSSFSAPEIPFYLILGLLAGLLATLFNRGILFSLTLQRRFHVSLAVKMGLAGLICGCVVSLLPPDFRNNRGLRELLITGAESWQFTSLALVTYFFLTLVSYGSGAPGGLFHPSLVLGSALGYLVGVAKLSFLGVGEPTTYALAGMGAFFSAVSKVPITAIVIIFEITADFNLVLPLMITCVVSYLIADQLSKGSLYQRLLEWRGYTSPTQKVDKGSLVGLTAEDLMQRQVETLSLHMTLDDALQMVSRSTHQGFPVVDEGTLVGIISQSDLTQATKMQGNPPRCPFPGTTPLAEIMTSHPITVKPTASLVDVLYLLNRYHLSRLPVTEGRKLLGIITRSDIIRAELDQLDSKTTQTRSQSEPSYVVYQTRSPETGRGRLLVPIANPQTAPILVKLAAAIARDRDYELECLQVILVSRSTSPAETPVTTTKSRRLLRQAEKWGRDWNIPVHTQIRVSQDITQGILDTIKERHINLMMMGWKGSTSTPGRIFGGVVDAVIRQAPCDVMVVKLGEMMHPPYIPPFFQRWLIPIAGGPNSQRALEFLPALIPLSSKPPDIRLCQVFDPEDTIMDTTAIEEASDFLKKQTEGRIRRIPIRASEVSDAVVYIANNQLCDVVVLGASREGLLQLMIQENIPEAIARRVKSTVILVRSAT

SEQ ID NO: 77 - DNA, 2592 bp, Nostoc punctiforme
atgttagccaggggtaaaattctctggttgaggctttcccgtcagttggttcaacccaggcgattggctttcgtggaagcttgcctgattggtctagtttctgggttagcggcagttctgttaggacaggcagtggattgggcaggcgcatggcgagtgcatctttcttaccattggtctgcctacttggtgctaccaggtattggactagcagggggacttttagctggttggctagtagagcacttcgcaccggaagcatcaggtagtggtatgtcggaagtgaaagcggtattggctcgtgtgccgatgccgttaaatctgcggattgctttggtaaagttgatcggcgctacattagtgttgggttctggaatgcctttaggacgggaagggccgactgtgcaaattggggcagccttggcaaatcaacttagtaactgggcaccgacttcaccagagcatcgtcgccaactgatcgccgcaggagctggggcaggattagctgcggcttttaatgcaccgatcgcaggtgtactatttgtagtggaagaattactccaagatgtgtcaggtatcactcttggtactgcgattttggcttctttcatcgcttcagtcatctctaggctctatggtagccacaacctggatctaaatcatctgaatttaggtcttcccgatacaactttcttcgctcaagaaatccctttctacttgattttgggagtattggcgggacttctaggcattctatttaataaaggtattcttaagagtctagcaattaaccgccgtttactacacgtgagtttaccctggcgaattggaattgctgggttagtcagtggtttggcgatcgctttattacctgctacctttcgcgatcatgctgggttgagagaaattttgcttgcgggtagtgctaactggtcatttgctgcgatcgctcttttagttcagtttatcttaattatttttacctacggctctggagcgccagggggtttactagttcccaccttagccctgggagctgcccttggttacttagtgggtgctgtcgaacacagtttactgggaatgagtgctgcaacagtctatgctcatgtcggcatggctgccttttttagcgccgtttctaaggttccaattacagcagttgtcattgtatttgagatgacaacagatttcaatctggtgctaccgctaatgattgcgtctgtggttgcctatttagtagcagaaaaaattgaccatcgatcgctctacgaccttttactagagtggaaggggattcacatcaccaaagagccaagcacagaggggcttctagcgcaactgagtgccttagatgtgatgcaacggcgtgtggaaactctctctagtcaaatgagtactgatgaagcagtgcaagcattttcccactctcaccatcgcaacttcccggttttagagaatggtaaagttgttggtattgtcactcaaaaaaatttagttaatattgcttcagaacaattaggcaaagatacaactatcggcgagattatgacaccagagccagtgacagtaacccccacggctacattggctcatgtactgcatatacttaatcgttatcatctcagctgcttacccgttacagaaaatcgcaagctcataggaattattactcgtagtgatattatccgtgtagaagcagagcgactcagtggtaattcccaacaaatagaacgtaaatcagcaccttcttatgtagtttaccaaactcgcgctccagctacaggcaaaggacgattattagtaccactttcacatcctcagacagccgagactttattggaaatggcagttgcgatcgccaaagatcgcaattacgaaatagaatgcctacaagtgattatcgttccgtctggccgcatcccatcggaaacaccagtacaaatcagcaaaagtcttcaacttttgcaacgggcaatacttttaggagagaattcgcggattcccgttcacacccagatccgagttgcccataatgttgctggagcaattttggagactgtcaaagaacgacacattgacttggtgttgatgggatggaaaggcagtacatcaactcctggtagagtttttagccgagtggtggataccataattcgacaggcaggttgtgatgttatcttggctaaattagatgataaaagatcctttgaccgttggttgttgccaatggcaggcggtcctaactccagccaagcaattaagttattacctgctctttcttctctaagtacatcgccccaaatcaagctatgtcaagttttccagcctactaactcgattcttgacacaacattattagataaatctgttcactttctgcaacgccgagttagcggtaaagtggtggctactccagttcgtgccaattctgtttctgatgctgtccttaagtgtgcagaacttgataacagtgatgtgattgttctgggagctagccgtgaaagcctactacaacaagcaattcaaggaaatattgccgagaatatttctcgcaagagtaattgtacagttatcatggtcaaaacttaa

SEQ ID NO: 78 - protein, 863 aa, Nostoc punctiforme
MLARGKILWLRLSRQLVQPRRLAFVEACLIGLVSGLAAVLLGQAVDWAGAWRVHLSYHWSAYLVLPGIGLAGGLLAGWLVEHFAPEASGSGMSEVKAVLARVPMPLNLRIALVKLIGATLVLGSGMPLGREGPTVQIGAALANQLSNWAPTSPEHRRQLIAAGAGAGLAAAFNAPIAGVLFVVEELLQDVSGITLGTAILASFIASVISRLYGSHNLDLNHLNLGLPDTTFFAQEIPFYLILGVLAGLLGILFNKGILKSLAINRRLLHVSLPWRIGIAGLVSGLAIALLPATFRDHAGLREILLAGSANWSFAAIALLVQFILIIFTYGSGAPGGLLVPTLALGAALGYLVGAVEHSLLGMSAATVYAHVGMAAFFSAVSKVPITAVVIVFEMTTDFNLVLPLMIASVVAYLVAEKIDHRSLYDLLLEWKGIHITKEPSTEGLLAQLSALDVMQRRVETLSSQMSTDEAVQAFSHSHHRNFPVLENGKVVGIVTQKNLVNIASEQLGKDTTIGEIMTPEPVTVTPTATLAHVLHILNRYHLSCLPVTENRKLIGIITRSDIIRVEAERLSGNSQQIERKSAPSYVVYQTRAPATGKGRLLVPLSHPQTAETLLEMAVAIAKDRNYEIECLQVIIVPSGRIPSETPVQISKSLQLLQRAILLGENSRIPVHTQIRVAHNVAGAILETVKERHIDLVLMGWKGSTSTPGRVFSRVVDTIIRQAGCDVILAKLDDKRSFDRWLLPMAGGPNSSQAIKLLPALSSLSTSPQIKLCQVFQPTNSILDTTLLDKSVHFLQRRVSGKVVATPVRANSVSDAVLKCAELDNSDVIVLGASRESLLQQAIQGNIAENISRKSNCTVIMVKT

SEQ ID NO: 79 - DNA, 2592 bp, Nostoc punctiforme
ttaagttttgaccataataactgtgcaattactcttgcgagaaatattttctgcaatatttccttgaattacctgttgtagtagactttcacggctagctcccaaaacaataacatcactgttgtcttgctgggcgcattcaagtacagcctcagaaacagaattggcttggactggagtcgccaccactttacctttaactcggcgttggagaaagtgaacagatttatctagtaatgttgtgtcaggtagagacttagtaggctggaatatttgacatagattgatttggggggatttacttaaggaagcaagagcaggtaataaccgaattgcttggctggagttaggaccacctgccattggcaacaaccaacggtcaaaagctcttttatcatccaatttggccaagacaacatcacaacctgcctgtcgaattatggtatctaccactcggctgaaaactctaccaggagttgatgtagtacctttccatcccattaataccaaatcgatatgtcgatctttgacagtctccaaaattgctccagcgacattatgggtaactcggatctgggtgtgaacgggaatccgccacttttctcctaacagtattgctttctgtaaaagctcaaggcttttggtaatttgtactggtgtttcagatgggatacggttagatggaacaataattacttgtaggcattctatttcgtaattgttagctttagcgatcgccccagccatttccaataaagtctcggctgtctgtggatgcgaaagtggtactagtaaccttcctttgcctgtagccggagcgcgagtttggtaaatcacataagaagttgctgatttcgattctatctgttgggtgttaccattcaacctctctgcttctacacggataatatcactacgagtaataattcctactagcttccgaccttctgtaacaggcaagcagctgaggtgataacgattgagtatatgcagcacataagccagcgtcgctgtgggactcgctgttactggctctggtgtcataatctggctgatagttgtatttccacttaactgttgcgaggcaagattaactaaatctttctgagtgacaatgccaacaactttacctttttctaaaattgggaagttgcgatgatgagagtcggaaaatgcctgcactgcctcatcaatactcatctggctagatagggtttcgacacgtcgctgcattacatctgcggcacttatttgtgctaaaatcccctctgtgcctggctcttttgtaatgtgaatccctttccactctagtagaaggtcatagagcgatcgcgggtcaattttttctgctactaaataagcaatcacagatacaatcattaacggtagcaccagattgaaatctgtcgtcatctcaaagacaatgacaactgctgtaatcggcactttagagacggcgctaaaaagtgcagccattcccacatgagcgtaggttgttgcagcactcattcccagcaaactctgttcggcagcaccaactaagtagccaagagcagcgcccaagaccaatgtgggaaccagcaaaccccctggcgctcctgagccgtaggttaaaataattagggtaaattggactaaaagagcgatcgctgcaaatagccaattcccactacctacaagcaaaatttctctcagcccagcattattgcgaaaggtgataggtaacagagcgatcgcaacaccagttactaaccccacaattccaattcgccagggtaaactcagatttagtaaacgccgattaattgccagacttgcaagaatacttttattaaacagaatgcctattagcccacctagcacccccaaaatcaagtagaaagggatttcctgagcgaagaaagtggtatgtgaaaagcttaaatccagatgattcagatccaagctgtgactaccatacaaccgggagatgactgaagcgatgaaagaagccaaaatcgcagtgccaagagtgatacctgacacatcttggagtaattcttccactacaaacaggacacctgcgatcggtgcattaaaagccgctgctaatccagccccggctccagcggcgatcagttggcggcgatgctctggtgaagtcggtacccaattactaagttgatttgccaaagctgccccaatttggacagttggcccttcccgtcctaaaggcattccagaacccagcactagtgtagcgctgaccagcttgaccagagcgattcgcagatttaatggcatcggcacacgagccaatacggctttgacttcagacatcccactacctgatgcttcaggtgcgaagcgctctactagccaaccagctaagattccccctaccagtccaatacctggtagtaccaagtaggcaggccagatgtaagaaagatgcactcgccatgctcccgcccagtctaccgcctgtcctaacagaactgctgctagcccagaaactaaaccaattatgcaagcttcaacgaaagccaagcgccttggtcgaagcagctgacgggaaagcctcaaccacagaatttttccccttgctaacat

SEQ ID NO: 80 - protein, 863 aa, Nostoc punctiforme
MLARGKILWLRLSRQLLRPRRLAFVEACIIGLVSGLAAVLLGQAVDWAGAWRVHLSYIWPAYLVLPGIGLVGGILAGWLVERFAPEASGSGMSEVKAVLARVPMPLNLRIALVKLVSATLVLGSGMPLGREGPTVQIGAALANQLSNWVPTSPEHRRQLIAAGAGAGLAAAFNAPIAGVLFVVEELLQDVSGITLGTAILASFIASVISRLYGSHSLDLNHLDLSFSHTTFFAQEIPFYLILGVLGGLIGILFNKSILASLAINRRLLNLSLPWRIGIVGLVTGVAIALLPITFRNNAGLREILLVGSGNWLFAAIALLVQFTLIILTYGSGAPGGLLVPTLVLGAALGYLVGAAEQSLLGMSAATTYAHVGMAALFSAVSKVPITAVVIVFEMTTDFNLVLPLMIVSVIAYLVAEKIDPRSLYDLLLEWKGIHITKEPGTEGILAQISAADVMQRRVETLSSQMSIDEAVQAFSDSHHRNFPILEKGKVVGIVTQKDLVNLASQQLSGNTTISQIMTPEPVTASPTATLAYVLHILNRYHLSCLPVTEGRKLVGIITRSDIIRVEAERLNGNTQQIESKSATSYVIYQTRAPATGKGRLLVPLSHPQTAETLLEMAGAIAKANNYEIECLQVIIVPSNRIPSETPVQITKSLELLQKAILLGEKWRIPVHTQIRVTHNVAGAILETVKDRHIDLVLMGWKGTTSTPGRVFSRVVDTIIRQAGCDVVLAKLDDKRAFDRWLLPMAGGPNSSQAIRLLPALASLSKSPQINLCQIFQPTKSLPDTTLLDKSVHFLQRRVKGKVVATPVQANSVSEAVLECAQQDNSDVIVLGASRESLLQQVIQGNIAENISRKSNCTVIMVKT

SEQ ID NO: 81 - DNA, 2589 bp, Anabaena variabilis
atgtactttcgcagttggttgcagcctagacggggtttagcgatcgccgaagcttgtgttattggggttttagctgcattatctgcggtattcctcaaggtttgttcgggattattaggtgcatggcgggttcatagttctcatgttttgcctgcatgggtagttttaccaatcatcggtttgggctttgggtatttggctggtctgatggtgcaaagattagcaccagaggcggcgggtagtggtatcccccaagtcaaggctaccctggcaaatataccgatgaaattgtcttggcgggtagcggtgattaagctactgagtgccattattgctttaggttctggcatcacattaggaagacaagggccgacagtccaagtaggggcaggtttagcgtcggggatgagtcgcttggttcccacttctcctgaccatcggcggcaaatgattgcggctggtgcgggtgcaggtttggcggctgcttttaatgctcccattgccggggtattattcattattgaggaattacttcaagatttatcgggattgactctgggaactgccattatcgcttcatttattggcggggtagtgtcccggttgttgggtggtcgcagtctaaatttaaatatagaattactttcctactccagccggtttacttttccagaaattcccttctttttgcttttgggtgttttagcggggttactgggtgcattatttaatcgtggcttgatttttagcctccagttttatcggagtctgcatattagtttacctttgcgggtcggtttggctgggttggtttcggggattgtcgtatcgctgttacctgagtcgtttcgggataatgctggtttaagggaatatgtaattactggtgatttaaatccaagctttgcagcgatcgcttttgttgctcagtttaccctaactttagtcgcatttggttctggcgcacccggaggtttatttgcgcctagcttaattttgggttcggctttaggacatttggtcggtgtattagagtatcaaatcactggtgatggttctcctgtgacttacgccttagcggggatgggaggtttttttagtgccgtttctaaagtaccaatcactgccattgtgattatctttgaaatgaccacagattttaatttagtgttgcctttgatgatagtgtctgtgacggcttacttggtagcagacaaagtagtacccggttcactgtatgagaaattattactgttgaatggcattaccctcactaaacagatgtcggtagaggggatattaagccaaatgactgcaaaagatgtgatgcagcaacgggtagaaactttagatgcagatattacccttgaagaagccaagcaagcctttgctagttcccaccatcgcggcttcccggtagtggaagataacaaattagtcgggattattacccaatcagatttaactaaaagcctcagccgcaatctagagaatcatcctcacctcagggaaatcatgaccgccaatcccatgacagtcacacccatacataccctgagtaatgttttatatttgctagaccgctatcaaatcagtcgcctaccagtagtagacgggcaaaaactcatcgggattatcacccgtgcagatatcattcgggtagaagcagaccgtctcaactgcgaaaaccccaacccaggcccccaaccggaaccatcctatgtagtttaccaaacgcggagtcccagcactggcagaggtagaatactagtcccagtagccaacccagaaaccgccgcaactctattaaaaatggcagctgccattgcccgcgatcgccattatgaaatagagtgtgtacaagtgatgctggtttctcgtcacagttccccttcagaaaccaccgtcagaaccgccaaaagtcgtcgccttctgcgacaagccgaagtattagccaaaaaatggcgcattcctctacacacccaaattagggtcgcccatgatcctgctcacgccattttagaaaccatcaaagaccgacacatagatttaattctcatgggatggaaaggcagcacatctaccccaggcaggatttttggcaatgttgtagacaccatcatccgccaagccacctgtgacgtagtactagtgaagttaggtacttccccaatccccaatcccccattcaatcgctggctagtcccaatggctggcggccctaacgccagaatagccattaaattattaccggctttagttactttaagcgatgacccacaaatccgcttgacaagggtgtttaaaccttgggaatttagaccagatatgacagttttagaacaagccattcgtcaattgatgcgtcgccgccaactatctagtactgtaattgctgcgccggtacaagctgattcagtagtcgaaggtgtgattaagttagtgaaaaccgaaggttatgatgtggtggttttaggcgcttcccgtgaaggtttattacaacaggctattcaaggtaatattccagaggcgatcgcttctggtgttgatattaccgtaattttggtaaggggagcaattgaaagttag

SEQ ID NO: 82 - protein, 862 aa, Anabaena variabilis
MYFRSWLQPRRGLAIAEACVIGVLAALSAVFLKVCSGLLGAWRVHSSHVLPAWVVLPIIGLGFGYLAGLMVQRLAPEAAGSGIPQVKATLANIPMKLSWRVAVIKLLSAIIALGSGITLGRQGPTVQVGAGLASGMSRLVPTSPDHRRQMIAAGAGAGLAAAFNAPIAGVLFIIEELLQDLSGLTLGTAIIASFIGGVVSRLLGGRSLNLNIELLSYSSRFTFPEIPFFLLLGVLAGLLGALFNRGLIFSLQFYRSLHISLPLRVGLAGLVSGIVVSLLPESFRDNAGLREYVITGDLNPSFAAIAFVAQFTLTLVAFGSGAPGGLFAPSLILGSALGHLVGVLEYQITGDGSPVTYALAGMGGFFSAVSKVPITAIVIIFEMTTDFNLVLPLMIVSVTAYLVADKVVPGSLYEKLLLLNGITLTKQMSVEGILSQMTAKDVMQQRVETLDADITLEEAKQAFASSHHRGFPVVEDNKLVGIITQSDLTKSLSRNLENHPHLREIMTANPMTVTPIHTLSNVLYLLDRYQISRLPVVDGQKLIGIITRADIIRVEADRLNCENPNPGPQPEPSYVVYQTRSPSTGRGRILVPVANPETAATLLKMAAAIARDRHYEIECVQVMLVSRHSSPSETTVRTAKSRRLLRQAEVLAKKWRIPLHTQIRVAHDPAHAILETIKDRHIDLILMGWKGSTSTPGRIFGNVVDTIIRQATCDVVLVKLGTSPIPNPPFNRWLVPMAGGPNARIAIKLLPALVTLSDDPQIRLTRVFKPWEFRPDMTVLEQAIRQLMRRRQLSSTVIAAPVQADSVVEGVIKLVKTEGYDVVVLGASREGLLQQAIQGNIPEAIASGVDITVILVRGAIES

SEQ ID NO: 83 - DNA, 2616 bp, Nostoc sp.
atgtactttcgcagttggttgcagcctagacggggtttagcgatcgcagaagcttgtgttattggggttttagctgcattatctgcggtattcctcaaggtctgttcgggattattaggtgcatggcgggttcatagttctcatattttgccggcatgggtagttttaccaatcattggtttgagctttgggtatttggctgggctgatggtgcaaagattagcaccagaggcggcgggtagtggtattccacaagtcaaagctactctagcaaatataccgatgaaattgtcttggcgagtagcaatagttaagctactgagtgctattctggctttgggttcagggctgacattaggaagacaagggccgacagtccaagtgggggcaggtttagcggcggggatgagtcgcttggttcccacttctcccgaccatcggcggcaaatgattgcggctggtgcgggtgcaggtttggcggctgcttttaatgcccctattgccggggtcttatttattattgaggaattacttcaagatttatcagggctgactctgggaactgccattatcgcttcatttattggtggggtagtttcccggctattgggtggtcgtagtctaaatttaaacatagaattactttcctactctagtggcttttcttttccagaaattcccttctttttgctgttgggtgtcttagcagggttactgggtgcattatttaatcgcgggttgattttcagcctccagttttaccggaatctgcatattagcttacctctgcgggtagccttggctggtttggtatcggggattgtcgtatcgctgttgcctgagtcttttcgggataacgctggtttaagggaatatgtaatcactggtgatttaaacccatcctttgcagcgatcgcttttattgctcagtttatcctaactttagtcgcatttggttctggcgcacccggaggtttatttgcgcctagcctaattttaggttcggctttagggcatttggtgggcgtattagagtatcaaatcacgggggatggttctcctgttacctatgccttagcgggaatgggtggtttttttagtgcggtttctaaagtcccaatcaccgctattgtgattgtctttgaaatgaccacagactttaacctagtgttgcctttgatgatagtgtctgtgacggcttacttagtagcagacaaagtagtacctggttcactgtatgagaaattattacttttaaatggcattaccctcactaaacagatgtcggtagaggggatattaagccaaatgactgcaaaagatgtgatgcagcaacgggtagaaactctagatgcagagataactttagaagaagccaagcaagcctttgctagttcccaccatcgcggcttcccagtagtagaagataacaaattagtcgggattattactcaatcagatttaactaaaagcctcagtcgcagtctagagaataatcctcacctcagggaaattatgacagccaatcctatgacagtcacacccatacataccttgagtaatgttttatatttattagaccgctatcaaatcagtcgcttaccagttgtagaagggcaaaaactgatcgggattattacccgtgcagatatcattcgggtagaagcagaccgtctcaactgcgaaaatcccaacccagggccccagccagaaccatcctatgtagtttaccaaacgcgaagtcccaacacaggcagaggtagaatactagtaccagtcgccaacccagaaaccgccgcgactttattaaaaatggcagccgccattgcccgcgatcgccattatgaaatagagtgtgtacaagtaatgctggtttcccgccacagttccccatcggaaaccacggtgagaaccgccaaaagtcgccgtcttctgagacaagccgaagtcttagccaaaaaatggcgcattcccctacatacccaaattagagtcgcccatgatcctgctcatgcaattttagaaaccattaaagaccgacacatagacttaattctcatgggatggaaaggtagcacatccaccccaggcaggatttttggcaacgttgtagataccatcatccgccaagccacctgtgacgtagtgctggtgaagttaggtagttccccattcccaatccccaatacccaatacccaatctccaatccccaattcaatcgctggctagtaccaatggctggtggccccaacgccaggatagcaattaaactgttaccagctttagtgactttaagcgatgacccacaaattcggttgacaagggtgtttaaaccttgggaatttagaccagatatgacagttttagaacaagccattcgtcaattgatgcgtcgccgccaactatctagtactgtaattgctgcgccagtacaagctgattcagtagtcgaaggtgtgattaagctagtggaaactgaaggttatgatgtggtggttttaggcgcttcccgtgagggcttattacaacaggctattcaaggtaatattccagaggcgatcgcttctggtgtcgatagtaccgtgattttggtaaggggagcaattgagagttga

SEQ ID NO: 84 - protein, 871 aa, Nostoc sp.
MYFRSWLQPRRGLAIAEACVIGVLAALSAVFLKVCSGLLGAWRVHSSHILPAWVVLPIIGLSFGYLAGLMVQRLAPEAAGSGIPQVKATLANIPMKLSWRVAIVKLLSAILALGSGLTLGRQGPTVQVGAGLAAGMSRLVPTSPDHRRQMIAAGAGAGLAAAFNAPIAGVLFIIEELLQDLSGLTLGTAIIASFIGGVVSRLLGGRSLNLNIELLSYSSGFSFPEIPFFLLLGVLAGLLGALFNRGLIFSLQFYRNLHISLPLRVALAGLVSGIVVSLLPESFRDNAGLREYVITGDLNPSFAAIAFIAQFILTLVAFGSGAPGGLFAPSLILGSALGHLVGVLEYQITGDGSPVTYALAGMGGFFSAVSKVPITAIVIVFEMTTDFNLVLPLMIVSVTAYLVADKVVPGSLYEKLLLLNGITLTKQMSVEGILSQMTAKDVMQQRVETLDAEITLEEAKQAFASSHHRGFPVVEDNKLVGIITQSDLTKSLSRSLENNPHLREIMTANPMTVTPIHTLSNVLYLLDRYQISRLPVVEGQKLIGIITRADIIRVEADRLNCENPNPGPQPEPSYVVYQTRSPNTGRGRILVPVANPETAATLLKMAAAIARDRHYEIECVQVMLVSRHSSPSETTVRTAKSRRLLRQAEVLAKKWRIPLHTQIRVAHDPAHAILETIKDRHIDLILMGWKGSTSTPGRIFGNVVDTIIRQATCDVVLVKLGSSPFPIPNTQYPISNPQFNRWLVPMAGGPNARIAIKLLPALVTLSDDPQIRLTRVFKPWEFRPDMTVLEQAIRQLMRRRQLSSTVIAAPVQADSVVEGVIKLVETEGYDVVVLGASREGLLQQAIQGNIPEAIASGVDSTVILVRGAIES

SEQ ID NO: 85 - DNA, 2592 bp, Nostoc azollae
atgttagccaggagtaaaattttttggttgaggctttcccgtcagctggttaaaccgaggcgcttggctttcgtggaagcttgcgtgattggtctagtttctgggttagcggcagttctgttaggacaggcagtggattgggcaggcgcattacgagtgcgtgtttcttaccattgtcctgcctacttagtactaccgagtattggactagtaggaggaatcttagctggttggctagtcgagtgctttgcaccggaagcatcaggtagtggaatgtctgaagtgaaagcagtattggctcgggtaccgatgccgttaaatctgcggattgctttggtcaagttgatcagcgctacgttagtgttgggttcgggaatgcctttgggacgggaagggccaactgtccaaattggggcagccttggcaaatcaatttagtaactgggctccgacttcaccagagcatcgtcgccaattgatcgccgctggagcgggggcgggattagctgcggcttttaatgcacctatcgcaggtgtgctttttgtagtggaagaattactgcaagatgtgtcaggtatcactcttgggactgcgattttggcttctttcatcgcttcagtcatttcccggctttatggtagtcacaaccttgatctgaatcatctaaatttaggtcttcccgatacaactttctttgcgcaggaaatcccattctacttgattttaggagttctggcggggtttataggcattctatttaataaaggtattctcgagagtctagcaattaaccgccgaatggtaaggttgagtttatcctggcgaattggaatcgctgggttagttagtggtgtggtgatcgctttattacctgctacctttcgcgatcatgctgggttgagagaaattttgcttgcaggtaatactaactggtcatttgcagcgatcgctcttttagttcagtttatcctaattatttttacctacggttctggagcgccagggggtttactagttcccaccttagtcttgggatctgcccttggttacttagtcggtgctatcgaacacagtttactgggaatgagtgctgcggcagtctatgctcatgtgggtatggctgctttttttagcgctgtatctaaggttccaattacggcagttgtcattgtatttgagatgacaacagattttaacctggtactaccgctaatgattgcttctgtggttgcctacttagtagcagaaaaaattgaccatcgatctctctacgaccttttactagagtggaaaggaattcatataaccaaggagccaagcagagaggtgcttctggcacaactcagtgccgtagatgtaatgcaacggcgtttggaaaccctctctagccagatgagtactgatgaagcggtacaggcattttcccactctcaccatcgcaacttcccagttttagagaatggtaaagttgttggtattgttactcaggaagatttagttaatattgcttcgcaaaagttaagtggagatacaactattagcgagattatgacaccagagccagtgacagtaactcccacagcgacactggctcatgtactacatatacttaatcgttatcatctcagctgcttgcttgttacagaaggtcgcaagcttataggaattattactcgtagtgatattatccgtgtagaagcagagcgacttagtggtaatagcgaacaaatggaacgtaaattagcaccttcttatgtggtttaccaaagtcgcgctccggctacaggcaaaggaagattgttagtaccgctttcacatccacagacagccgagactttactagaaatggcagttgcgattgccaaagatcgcaattacgaaatagaatccctacaagtgattattgttccgtctagccgtattccatcggaaacaccagtacaaatcagcaaaagtcttcaacttttgcaacgggcaatacttttaggagagaattcgcggattcccgttcacaccgagattcgagttgctcataatgttgctggggcaattttggagactgtcaaggaacgacacattgacttggtactgatgggatggaaaggcagtacatcaactcctggtagagtttttagccgagtcgtggataccataattcgacaggcaggttgtgatgttatcttggctaaattagatgataaaagatcctttgaccgttggttattgccaatagcaggtggacccaactccagccaagcaattaagttattacctgcgctttcttctttaagtaggtcatcccaaatcaatctatgtcaagttttccagcctaataactctattcccgatacaactttattagataaatccgttaactttctgcaatgccgagttagtggtaaagtagtggctaccccaattcgtgctaattctgtttctgatgctgtcctccagtgtgcagaacaagataagagtgatgtaattgttctgggagctagttgtgagagtttactacaacaagcgattcaaggaaatattgctgaaaatatttctcgtaagagtaattgtacagttatcatggtcaaaacttaa

SEQ ID NO: 86 - protein, 863 aa, Nostoc azollae
MLARSKIFWLRLSRQLVKPRRLAFVEACVIGLVSGLAAVLLGQAVDWAGALRVRVSYHCPAYLVLPSIGLVGGILAGWLVECFAPEASGSGMSEVKAVLARVPMPLNLRIALVKLISATLVLGSGMPLGREGPTVQIGAALANQFSNWAPTSPEHRRQLIAAGAGAGLAAAFNAPIAGVLFVVEELLQDVSGITLGTAILASFIASVISRLYGSHNLDLNHLNLGLPDTTFFAQEIPFYLILGVLAGFIGILFNKGILESLAINRRMVRLSLSWRIGIAGLVSGVVIALLPATFRDHAGLREILLAGNTNWSFAAIALLVQFILIIFTYGSGAPGGLLVPTLVLGSALGYLVGAIEHSLLGMSAAAVYAHVGMAAFFSAVSKVPITAVVIVFEMTTDFNLVLPLMIASVVAYLVAEKIDHRSLYDLLLEWKGIHITKEPSREVLLAQLSAVDVMQRRLETLSSQMSTDEAVQAFSHSHHRNFPVLENGKVVGIVTQEDLVNIASQKLSGDTTISEIMTPEPVTVTPTATLAHVLHILNRYHLSCLLVTEGRKLIGIITRSDIIRVEAERLSGNSEQMERKLAPSYVVYQSRAPATGKGRLLVPLSHPQTAETLLEMAVAIAKDRNYEIESLQVIIVPSSRIPSETPVQISKSLQLLQRAILLGENSRIPVHTEIRVAHNVAGAILETVKERHIDLVLMGWKGSTSTPGRVFSRVVDTIIRQAGCDVILAKLDDKRSFDRWLLPIAGGPNSSQAIKLLPALSSLSRSSQINLCQVFQPNNSIPDTTLLDKSVNFLQCRVSGKVVATPIRANSVSDAVLQCAEQDKSDVIVLGASCESLLQQAIQGNIAENISRKSNCTVIMVKT

SEQ ID NO: 87 - DNA, 2592 bp, Nostoc punctiforme; identical to SEQ ID NO: 79

SEQ ID NO: 88 - protein, 863 aa, Nostoc punctiforme; identical to SEQ ID NO: 80

SEQ ID NO: 89 - DNA, 2589 bp, Anabaena variabilis; identical to SEQ ID NO: 81

SEQ ID NO: 90 - protein, 862 aa, Anabaena variabilis; identical to SEQ ID NO: 82

SEQ ID NO: 91 - DNA, 2616 bp, Nostoc sp.; identical to SEQ ID NO: 83

SEQ ID NO: 92 - protein, 871 aa, Nostoc sp.; identical to SEQ ID NO: 84

SEQ ID NO: 93 - DNA, 2592 bp, Nostoc azollae; identical to SEQ ID NO: 85

SEQ ID NO: 94 - protein, 863 aa, Nostoc azollae; identical to SEQ ID NO: 86

SEQ ID NO: 95 - DNA, 2652 bp, Nostoc punctiforme
tcacttgtgaattgcacccctgaccaaaatcactgtactttctacaccagaggcgatcgcttcgggaatattaccttgaatcgcctgctgcaacaatccctcgcgggaagctcccaaaactacaacatcgtaaccctcggttttcactaggttaatcacaccttcagctactgaatcagcttgcactgggatcgcaactacagtactagataattttcgccgccgcatcaactgacggatggcttgttctgaaattgacatatctggcttgagttcagatggattaaacacctgtgtcaagcgaatttgcggatcgtttcccaatgtaattaaagcaggtaacaacttaatcgctaggggagaattgggaccgccagccattggaactagccagcgattgaaagaatgctgagtctggagtgctgtttgcggatagctatgatttggcttgtgctgagttttgcccaattttaccaaaactacttcgcaggtggcttggcgaattatgttgtctacaacgctgccaaaaatccgaccaggggtagatgtgttacctttccatcccattaaaattaggtcgatgtgttgttcgttgattgtctctaaaattgcttgggcgacatcgtgggtaactcgaatctgcgtatgcaaggggattttccacttttttgctaagacttctgcctgtcttagcaagcggcgactttttgccgttcttacctgtgtttctgatggagaactgtggcggggtatcagcataacttgcacgcaatctatttcataatggcgatcgcgggcaatagctgctgccatttgtaataaaatacctgcagtatcgggattagctactggtactaataatctacctctaccgatgttgggcgatcgcgtttggtaaactatgtatgaaggttctggttgcagcttaggagttccatttccacaattgagatgatctgcttccgcccgaataatatctgcacgggtaataatcccgataagtttccgtccatttaccactggtaagcgactgatttgatagcgatcgagtaaatacaacacattgcccagagtgtgagtcggtgttaccgtcatcgggacagttgtcataatttcttttaagaaaatatcggctaaattgcgatcgcgaaatgtgtggtttgtactctcgcgtattttcaacaaatctgattgcgtcacaatccctactaacttgctatcctctaccacaggaaaaccgcgatgatgggaacgagcaaaggactgcattgcttcttctaagctcatctctgcatccagagtttccactcgttcttgcatcacatcttttgcagttaacttggttaatgctccctccatcggaacttgtttggtgagagtaataccttttaactccaaaagtttctcataaagcgaacctgatactaccttatccgcaaccagataagctgctacagaaacaatcattaaaggtagtaccagattgaaatctgtagtcatttcaaacacaatcacaattgctgtgattggcactttggaaacggcgctaaaaaatccacccatccccgctagggcgtaagtagtcggagaaccaactccagtgatatataactcagctacaccgatgatatgtcctaaacaagaacccaaaatcagactgggagcgaataacccccccggcgctcctgaaccaaatgctataagtgtgaggatgaattgggcggtaaaggcgatcgctgctactgtaggatgggaacctccagtaattaaggattctcgtaaccccgtattatcccggaacgatggagggagcatagccacgacaacaccagaaataaatccagctaaagccactcgcaacggtaagctgatatgtaatcttctataaaatttaatactaaatattaagccgctattaaacaatgcacccagcaaccctgccaagatgcctaacagtacgaaaaagggaatttctgggatagaaaattggctggaagattgcgttaattgcaggttaaggtcaaaagagccaccacctaagagtcgggatatcaccccaccaataaaggaggcgataatggcagttcccagggtcaatcctgataaatcttggagtaactcctcaacgataaacaatacacctgcgatcggggcattgaaagcagcagccaaacccgcacctgcaccggctgcaatcatttgccgtcgatgatctggggaagtgggaacccaacgactcatccctgctgctaaacctgcccccacttggacagtagggccttgccgtcctagagtcatgcctgaaccaatggcgatgatagcactgagtaacttcacacctgctacccgccaggataaattcacaggtacattggcaagactagctttaacttgcggaataccgctaccataagcctctggtgccaatctatccaccaaccatccagctataaatcccagaacaagaccaattacaggtagtaccagccatgccggaaaaaggtgggtagtatgtactcgccatgtccccagccatcccgatcctactttcaggaataccgcagatagggcagcaaccaaaccgataacacaagcttcggcgatcgctaaacctcttctaggctgccaccaggtgcgaaaacgctgattcat

SEQ ID NO: 96 - protein, 883 aa, Nostoc punctiforme
MNQRFRTWWQPRRGLAIAEACVIGLVAALSAVFLKVGSGWLGTWRVHTTHLFPAWLVLPVIGLVLGFIAGWLVDRLAPEAYGSGIPQVKASLANVPVNLSWRVAGVKLLSAIIAIGSGMTLGRQGPTVQVGAGLAAGMSRWVPTSPDHRRQMIAAGAGAGLAAAFNAPIAGVLFIVEELLQDLSGLTLGTAIIASFIGGVISRLLGGGSFDLNLQLTQSSSQFSIPEIPFFVLLGILAGLLGALFNSGLIFSIKFYRRLHISLPLRVALAGFISGVVVAMLPPSFRDNTGLRESLITGGSHPTVAAIAFTAQFILTLIAFGSGAPGGLFAPSLILGSCLGHIIGVAELYITGVGSPTTYALAGMGGFFSAVSKVPITAIVIVFEMTTDFNLVLPLMIVSVAAYLVADKVVSGSLYEKLLELKGITLTKQVPMEGALTKLTAKDVMQERVETLDAEMSLEEAMQSFARSHHRGFPVVEDSKLVGIVTQSDLLKIRESTNHTFRDRNLADIFLKEIMTTVPMTVTPTHTLGNVLYLLDRYQISRLPVVNGRKLIGIITRADIIRAEADHLNCGNGTPKLQPEPSYIVYQTRSPNIGRGRLLVPVANPDTAGILLQMAAAIARDRHYEIDCVQVMLIPRHSSPSETQVRTAKSRRLLRQAEVLAKKWKIPLHTQIRVTHDVAQAILETINEQHIDLILMGWKGNTSTPGRIFGSVVDNIIRQATCEVVLVKLGKTQHKPNHSYPQTALQTQHSFNRWLVPMAGGPNSPLAIKLLPALITLGNDPQIRLTQVFNPSELKPDMSISEQAIRQLMRRRKLSSTVVAIPVQADSVAEGVINLVKTEGYDVVVLGASREGLLQQAIQGNIPEAIASGVESTVILVRGAIHK

SEQ ID NO: 97 - DNA, 2580 bp, Nostoc azollae
ttaagaattaatttcccctctgactaaaatcactgtactttcaacaccagaagcaatagtttcgggaatattaccttgaattgtctgttgtaataatccctcacgagaagcgcccaaaactacaacatcatagcgttctgtttgcactaaattaatgactccttcacaaacagaatttgcttgtactggtgcagcaacaactgtactttgtaaattgcggtgacgcattagttgatgagtggattcttctaaaactgttatatctggctttaattccgatggtttaaatacctgagtgagatgaatttgggtattatttcccaatgttactaaagccggtaataatttaacggctttagtaacattgggtcctccagccatagggactaaccaacggttgaaatggttagagtcagaaatattaccaaattttactaagacaacatcacaggctgcttgacgaatgatagtatctacaacattaccaaaaatacgtcctggagtagaagtattacctttccaacccataaaaattaggtcaatgtgtcgttcattgattgtctccaaaattgcctgggcgatatcatgggcgactcgaatctgcgtatggatgggaatatgccatttttttgctaaagctttcgcttgcctgagtaaacggcgactttttgtggtgttgacttgggtttcggacggggaactatgacgggagatgaggattatttgtaagcactctagttcataatggcgatcgcgggcaatagttgcagccatttgtaaaagagtttcggctgtatctggatttgcgactgtaactaataatctacctctaccaatgttaggcgatctcgtttggtaaactacataagaaggttctggttggggtccagaaactccgttttcacaattaagatgatctgcttcagccggaataatatctgcgcgagtaataatcccgaccaatttttgtctttccaccactggtaaacgactgatttgataacggtcaagtaaataaagcacattacttagagtttgtttaggagtaactgtgacaggctggggtctcatgatttctcttaaaggagtatcccgactcacaggtattttctgtaaatctgattcagtaacaactcctaccaatttacagttttctaccaccggaaaaccccgatgatgagaacgagaaaatgcttgaataacttcatcaacagacatctgtgtttctagagtttccacccgttcttgcattacatcttgggctgttaattgagttaagactccttctctggttgcatcttttttgatgccatttaatagtaaaagtttgtcatacagtgaaccaggtactagctgatctgcaactaaatatgatattacagaaacaatcatcaaaggtaacaccagattgaaatcagtagtcatttcaaacacaattacaatagctgtaattggtactttagaaaccgcactaaaaaagccccccattccagctaaagcgtaggtagtaggacaacctaaaccccacagttgaaactcacacactcctaccaagtgtcctaaacaagaacctaaaatcaaactgggtgcaaataatccaccaggtgcgccagaaccaaaggcgattaaggttaaaataaattgagcaatcaaagtaattgcagcaaagctgggattaggttgactggcaatcatatattcccgtaaacctgtattgtcacggtaatattcagggagagcagagacaattaaaccacaaaataaaccagttcgagccactcgtagtggtaaacttatatgtaatccgcgataagttttaacactaaaaattaagcccagattaaatattgcacctagtagacctgcgaaaatacccaatagtaaaaagatcggaatttccaacaatgagaaactactaaaatattccattgattgcaggtttaattgcaaacttccaccacctaacaaccgggaaattaccccaccgataaaacaggcgataatggcagttcctaaagttagtcctgataaatcttgcagtaactcttcaataataaataatacccccgcaattggggcgttaaaagcagccgataaacctgcacctgcaccggcagcaatcatttgtcggcgatgttctggagaggtgggaaaagtgcgactcattcccgctgctaaacttgcaccgatttgaactgtggggccttgtcttcctaaagttatacccgaacccaaggagatgattgtgctgagtaattttataccttccacccgccaggataacttgattggtatattggcaagactggctttaacttgaggaataccactacctgcggcttctggtgctaacctttgtaccaaccaaccagctaaaaacccaaaactcatgccaattaacggtaaaatgagccaagcaggtacaaattgggtactatgaactcgccatgtacccaagcatcctgaaccttgtttcagtaaaacagcagataaagcagcaactatgccgatcatcgaagcttcggcattagcatatcccattgaccaaaaagggagacgcaagcccctagctttagacat

SEQ ID NO: 98 - protein, 859 aa, Nostoc azollae
MSKARGLRLPFWSMGYANAEASMIGIVAALSAVLLKQGSGCLGTWRVHSTQFVPAWLILPLIGMSFGFLAGWLVQRLAPEAAGSGIPQVKASLANIPIKLSWRVEGIKLLSTIISLGSGITLGRQGPTVQIGASLAAGMSRTFPTSPEHRRQMIAAGAGAGLSAAFNAPIAGVLFIIEELLQDLSGLTLGTAIIACFIGGVISRLLGGGSLQLNLQSMEYFSSFSLLEIPIFLLLGIFAGLLGAIFNLGLIFSVKTYRGLHISLPLRVARTGLFCGLIVSALPEYYRDNTGLREYMIASQPNPSFAAITLIAQFILTLIAFGSGAPGGLFAPSLILGSCLGHLVGVCEFQLWGLGCPTTYALAGMGGFFSAVSKVPITAIVIVFEMTTDFNLVLPLMIVSVISYLVADQLVPGSLYDKLLLLNGIKKDATREGVLTQLTAQDVMQERVETLETQMSVDEVIQAFSRSHHRGFPVVENCKLVGVVTESDLQKIPVSRDTPLREIMRPQPVTVTPKQTLSNVLYLLDRYQISRLPVVERQKLVGIITRADIIPAEADHLNCENGVSGPQPEPSYVVYQTRSPNIGRGRLLVTVANPDTAETLLQMAATIARDRHYELECLQIILISRHSSPSETQVNTTKSRRLLRQAKALAKKWHIPIHTQIRVAHDIAQAILETINERHIDLIFMGWKGNTSTPGRIFGNVVDTIIRQAACDVVLVKFGNISDSNHFNRWLVPMAGGPNVTKAVKLLPALVTLGNNTQIHLTQVFKPSELKPDITVLEESTHQLMRHRNLQSTVVAAPVQANSVCEGVINLVQTERYDVVVLGASREGLLQQTIQGNIPETIASGVESTVILVRGEINS

SEQ ID NO: 99 - DNA, 2703 bp, Lyngbya sp.
atgttgcgaatttctattcccgagcaactttcaaaacggttcaaaataatcgcgactcaaatcctacaacctcaatctcagagacgcttggctatcctggaagcctgtatgattggtttagtctctggattggctgctttctgcttgcgagtaggagcgggatggttagggtcatggcgaatctatggtgcccttaatagtcccctacccgtttgggtgtttttgccgagtgtgggactgattggcggctttctcactggatttttagttgaacgatttgctcccgaaacgactggaagcggagttccccaggtaaaggcggctttaagtggaatgcccatttctctagactttcgagtcgctatctccaaactactcggaacaatgtttacgatgggttcgggtttaaccctcggacgccaagggccaaccgttcaaattggtgccgccctcgctgcttggattgggcgttgggtgccaacttctccaaactacagccgccaaatcatcgcttgtggggcagccgccggattagccgccgggtttaacgctcccattgcaggtgttttatttgtcgtcgaagacttactccacgatatttctggtattaccttggggcctgcaattatcgcctcctttatcggggcggtggtttctcgtctcttagaaggtcaaaaccccgactttgaacccccttcagctgaagttatggaacgttcctatcagcaatggttaattcaaccgggtgaaattcccttttacatcattttgggtattctggcgggtgtactgggaacgctatttagtcgaagcattgtttctgccctccaatttagccgcaaagccttttcattgggactcccggtacgaatggcattagcgggatttttgtgtgggttaattgtttctgtcttacctgtggaatttcgcaacaatgcaggtttgcgggaatttcttctgagtggggaactcaactggacaatcaccgccctagcttttgttgctcactttgtcctgacaacaattgcggcgagttcttcggcacctggcggtttatttgccccctcgctggttttaggagcggcgctcggtaaattgattgggatatgggaatttagcttaattggcttggaacccccaacaaccttcgcctatgcgggaatgggagctttcttttgtgcggtatctcgaacgccaattactgccgttgtgattgtatttgagattacccgagattttaacttagtgttgcaattgatgatttgttcggttgttgcctactttgtcgctgataaaatcgataaacattccctctatgatcgcctactcaaattaaacggtattgagttaaaagaagatcaacttgatcgcgaagcgttgagtaaattactcgccagagatgtcatgcaacgtcaggtggaaaccttatcgagtcagttaccgcttttacaagttagacaggagttttctcgctcccaacatcgagggtttccggttgtagaaaatggcaaactggtggggatagttacccaaagagatttgagtaatgttagtcagcaaaatttgcccgaggatacgcctttacacaagtttatgacttccaaaccgattgcggtgactccggatgaaactcttactcaagttctctatttacttggtaaatataaacctagtcgtttacctgttgttgaaggtcgtcatctggttgggattattacccgcagtgatattattaaagcggagttgggcattcttagcggtgaagatacacaagtcgggttgcatccagaaccttcctatgttgtctatcaaacccgagcgcctcaagttggtcaaggacggatgttggtttcccttcataaccccaaaactgctccctctctgttggaaattgccgcagcgatcgctcgggaacgaaattatgagatagaatgcttaaacgtgattacgatacctcgtcaccgttcgccgagtgaaacgcctgttcgactcactaaaagtcggcgtttgatgcgacaagctgaacaaatggggcgggcttggaaaattcccttacatactcaagttcgggtgacaaatgatgttgctcaagcgattcttgaaacgacaaaagagcgacatattgatctgattttgatgggttggcaaggtaaatcttcgactagcgatcgcgtttttggtaatgtcgtagatatgattattcgagcctgtgagtgtgaaatggttttggtcaaatggccgcaaatggttgatccttttggttcaaaacggaagttgcgcttacattctcttttaggttggcaacggtggttagttccgattcgggatgatgctaaaaagtcggttgcggttcaacttttaccagctttaacacacttgagtcatcaagccgaaattcgtttgttaaaagtgatgaataaagaggtttctgtttcggaaaaacgggcttgggagcatacttcccaggagttaagttctttattgaattctaaagtgagaatcacggcggtgacttctgagtttgttccggatgcggtgattgattttgcttatcaagaacattgtgatgttgtggttttgggggcgagtcgtgaaggaatgctgaaacaagtgattcaaggaaatattcccgaagcgatcgctcgtcattgtgattgtactgtgattttggttcgtcccgcaatcggtcatgcagccgattaa

SEQ ID NO: 100 - protein, 900 aa, Lyngbya sp.
MLRISIPEQLSKRFKIIATQILQPQSQRRLAILEACMIGLVSGLAAFCLRVGAGWLGSWRIYGALNSPLPVWVFLPSVGLIGGFLTGFLVERFAPETTGSGVPQVKAALSGMPISLDFRVAISKLLGTMFTMGSGLTLGRQGPTVQIGAALAAWIGRWVPTSPNYSRQIIACGAAAGLAAGFNAPIAGVLFVVEDLLHDISGITLGPAIIASFIGAVVSRLLEGQNPDFEPPSAEVMERSYQQWLIQPGEIPFYIILGILAGVLGTLFSRSIVSALQFSRKAFSLGLPVRMALAGFLCGLIVSVLPVEFRNNAGLREFLLSGELNWTITALAFVAHFVLTTIAASSSAPGGLFAPSLVLGAALGKLIGIWEFSLIGLEPPTTFAYAGMGAFFCAVSRTPITAVVIVFEITRDFNLVLQLMICSVVAYFVADKIDKHSLYDRLLKLNGIELKEDQLDREALSKLLARDVMQRQVETLSSQLPLLQVRQEFSRSQHRGFPVVENGKLVGIVTQRDLSNVSQQNLPEDTPLHKFMTSKPIAVTPDETLTQVLYLLGKYKPSRLPVVEGRHLVGIITRSDIIKAELGILSGEDTQVGLHPEPSYVVYQTRAPQVGQGRMLVSLHNPKTAPSLLEIAAAIARERNYEIECLNVITIPRHRSPSETPVRLTKSRRLMRQAEQMGRAWKIPLHTQVRVTNDVAQAILETTKERHIDLILMGWQGKSSTSDRVFGNVVDMIIRACECEMVLVKWPQMVDPFGSKRKLRLHSLLGWQRWLVPIRDDAKKSVAVQLLPALTHLSHQAEIRLLKVMNKEVSVSEKRAWEHTSQELSSLLNSKVRITAVTSEFVPDAVIDFAYQEHCDVVVLGASREGMLKQVIQGNIPEAIARHCDCTVILVRPAIGHAAD

SEQ ID NO: 101 - DNA, 2592 bp, Cyanothece sp.
atgggatcacttgcggcactgcggcggttacaacagttgctccgaccgaggcgggtggcggttctggaagcttgcttcattgggctggtatctgcactggcggcggggggaatggcctggggcgtgggctggatgggaacctggcgggtgaatctggcggaacaatggccggactggcttgttcttcccctgtttggggcgatcggggccttgctctccggggcactggtcttacgagaagctccagaagccgctggcagtggtatgtctcaggtcaaagcagtgctggccagagttcccatgcccctcaacctgcggattgccctggttaaactgatcagtgcggtgctggcgcttgggtcgggtctggccctgggcagggaagggccaaccgtgcaggtgggagctgctttagctgcacaattaagccactggttacccacctcgcctgaacaccgccgtcagctcattgccgctggagccggagctggtttagctgcagcctttaatgcgcccatttccggggtgttgtttgtggcagaagaactgatgcaggatgtttccggtggcaccctgggcacagccattctggcctcctttattggcagtagtgtctctcgtttgctgggaggtaacagtctggatgtgaatctggaagccagcaaaatgctcaccagctttacgctgacggaaattcctgcctatctggtactggggggattggctgggctactgggggctatttttgatcacgccgttctgatcagtctcaaattgaatcggcgttatcttcccctgagtttgccttggcgcatggccctggccggactgatcaccgggttgctgattgcccttttgccggagtcgtttcgcaactatgccgaactgaaggaagccctgttgtcaggacaaattacctgggctggggcagcgctcttttttgtgagctactttcccctgatcctgattgcctctggttccggggcccctggtgggctgctcgttcccaccctgttgttgggagcaatgctgggctgctggctggggggaatgcaacacagctttttaggtctgggagtagccgtaagctatgcgcgggtggggatgggtgcatttatggctgctacggcaaaagcacccgtgacggccatcgtcattgtctttgaactaacccatgactttaacctggtcttacccctgatgattgcctccgtgatcgcctacctggtctcggaacgcctcttccccggttccttctacgacagaattctagagctgaatggcatttatctgaatgagctcaccaccgttaataccagcctggcagacatgaccgccgcccaggtgatgcaacggcaggtggaaacccttcgcagtgatatgcccctagaagaagccgttcaagccttttcccgttcccatcaccgtggctttcccgttctggaggaggacaaattggtgggaattgtcacccagactgatctaaacacgatcaagcagcggccgttaccccccaacacccccctgcagcagatcatgaccccctggccaatcaccattcccccccaggaatccttggctaatgtgctctatctgctcaaccgctacaatctcagccgtctccccgtggtggaaggccgtaaactgatcggcattattacccgaagcgatattattcgagcggaagcctctgaactaagtggggaacgacaacaattagccccccgcgtgcaaccctcctacctggtctatcaaacccgctgcactgctagtggacagggacggctgctccttcccctggctaatccggccaccgccgatcgcttacttcagatgggcttagcgatcgcccgtgaacgccagttagagctggagtgcctgcaggtgattgtggtaccccgccacagtgatcccagcactaccccagtccgcactaccctcaatcggcggttattgcaacggatggaacgtctagcccgcccagactccgttccattacatacccagatccgggtcgctcaggatgtggccggggccattctggaaaccattagcgatcgccacattgatgtggtgctgatgggctgggaaggggaaagcctgaccccaggcagcatctttggctctgtcgtggatacgatcgttcaccaggctgagtgtgatgtagttctggtcaaactggcacaggagaacgtgcggttcgatcgctggctcgttccgatcgccggggggccaaatgtccaacgggccatgcaactgttgcccggactcacccgtctcagcccagctccccaggtgaggctctgccaggtgtttgacccggaggcaaccctactggatacccaggcgctggaacagggaatggcattactcaaacctcacctgaatggggccctcagtagtctttccctgcgctctaaatccattgctgaagccattattgagctagcccacgccgaacaggacgatgtcatcctggtgggagccagccgggaaggattactccgtcaggcaattatgggcaatattccctccgcgatcacccgtaatagccattgcagcgtgatcctggtgcggggagcattggagtaa

SEQ ID NO: 102 - protein, 863 aa, Cyanothece sp.
MGSLAALRRLQQLLRPRRVAVLEACFIGLVSALAAGGMAWGVGWMGTWRVNLAEQWPDWLVLPLFGAIGALLSGALVLREAPEAAGSGMSQVKAVLARVPMPLNLRIALVKLISAVLALGSGLALGREGPTVQVGAALAAQLSHWLPTSPEHRRQLIAAGAGAGLAAAFNAPISGVLFVAEELMQDVSGGTLGTAILASFIGSSVSRLLGGNSLDVNLEASKMLTSFTLTEIPAYLVLGGLAGLLGAIFDHAVLISLKLNRRYLPLSLPWRMALAGLITGLLIALLPESFRNYAELKEALLSGQITWAGAALFFVSYFPLILIASGSGAPGGLLVPTLLLGAMLGCWLGGMQHSFLGLGVAVSYARVGMGAFMAATAKAPVTAIVIVFELTHDFNLVLPLMIASVIAYLVSERLFPGSFYDRILELNGIYLNELTTVNTSLADMTAAQVMQRQVETLRSDMPLEEAVQAFSRSHHRGFPVLEEDKLVGIVTQTDLNTIKQRPLPPNTPLQQIMTPWPITIPPQESLANVLYLLNRYNLSRLPVVEGRKLIGIITRSDIIRAEASELSGERQQLAPRVQPSYLVYQTRCTASGQGRLLLPLANPATADRLLQMGLAIARERQLELECLQVIVVPRHSDPSTTPVRTTLNRRLLQRMERLARPDSVPLHTQIRVAQDVAGAILETISDRHIDVVLMGWEGESLTPGSIFGSVVDTIVHQAECDVVLVKLAQENVRFDRWLVPIAGGPNVQRAMQLLPGLTRLSPAPQVRLCQVFDPEATLLDTQALEQGMALLKPHLNGALSSLSLRSKSIAEAIIELAHAEQDDVILVGASREGLLRQAIMGNIPSAITRNSHCSVILVRGALE

SEQ ID NO: 103 - DNA, 2577 bp, Gloeobacter violaceus
atgcaatcctggctgcagaattttcggcaactgctccgtccccagcgcctcgcgacgctggaagcgtgcctgatcggtctggtggcggggctcgcggcggtcatcctcaagcagggcgccgacctcctcagccactggcgcctcgacgctgcgggatcattcggctggtgggtgttgccgctgctcgggcttttggggggagtgacggccggctggttggtggagcgcttcgctccggaagcttccggcagcggcatcccccaggtcaaggcggtgcttgcccgcgtgccgatggcgctcgatctgcgcgtcgccctcgtcaaactggtgggcacgatggtgacgctgggttcagggtttccgctcgggcgcgaaggcccgaccattcagatcggcgcggcgctggccaaccagctcagccgctgggtgcccacttcccccgcttaccgccgccagttggtggccgccggggcgggagcgggattggccgccgccttcgacgccccgatcgccggggtgatctttgttgtcgagcaactgctgcagaacgtttcgggcctcaccctgggggtggccatcctcgcctcgtttatcggcgcggtgctctcgcgggtcctggggggcttcagcttcgacctcaaatcgagcatggccgattttcagaccggttttacggttcaggagatcccgttctatctgttgctcggggtgatggcgggggtgctcggagcgctctacaaccgggggctaatcgcgagccttacctttaaccggcgggtgctgcgtctgaacatgcctttgcgggtgggccttgccggactggttatgggcgggagcctggcgctgctacctgcggtctttcgcgacggcgaagcgttgcgcgggctgattatcggcgcgcaggaaccctggcagttcgccgccctcgccttcgtggcccagtttgtgctgacactcatcgcctatggctccggggcaccgggcggcgtgttcgccccctcgctggtgctgggggctgccctgggttcgctggtgggcacgctctcctacagcaccctggccgtcaacgcgcccatcacctactcgctggtcgggatgggggcatttttctgtgcggtgacccgcgtgccgattacggcggtgatcattattttcgagatcaccaacgacttcaacctggtgctgcccttgatggtcgtctgcgtggtcgcttcgctggtggctgagcgcctcaacgaaggctcgatctacgaccaacttttggcctggaacggcatccgtctgggcgaggaggcggtgagcgacgagaagctgctcgctcaactggcggcgggcgatgtcatgcagacgcgcctggagacgctggagagcacgcttcccctcagcgaagtgtcccaggcgttttcgcgctcgcaccaccggggctttccggtggtcaaggacgagaagctggtggggatcgtcacccagaccgatctgatgaagatcgcggcgcgcaatctgccgcccaccgccccgctcagcgaactgatgacgccgcagccggtcaccgtcactccccgcgacagcctcaaagaggtgctctatttgctcaatcgctacgaattgagccgcctgccggtggtcgaggaggccaagctggtagggatcatcacccgcagcgacatcatccgcgccgaggcggatttgctcagtggcgacacccaggcggtgggtccgcgccccgacccgtcctacgtggtctaccagacccgcgctccggccttgggaggcggtcgcctgctgttgcccctggccaatccggacaccgccccggcgcttttggaatttgccctggccatcgcccgcgcgcgcaacctcgaactggagtgtctgcacgtcatcgccgtaccccgcaccagcgcaccctccagcaccccggtggcagtggccccggcagtcaacctcgtgcgccaggccgtgcgcgccggtcgcgccgtcggggtgccggtacacacccaggtgcgcgtcgcccacgatatcgcccaggcggtgctcgaaacggtcaaagagcggcgcatcggcctggtgctgatgggttggcggggggtgaacacctccccggagcgcatcttcagcaacaccgtggacacgatcatccgccaggcgccatgcgaggtgctcctggtcaagctcaaaggcgacgcgatcccgcgccgctggctggtgcccatcggcggcggccccaacgcccaggaggccattaagattctgcccgccttattgcgccgcggccccggcaagagcgagatcgccgtctgccaggtcttcgcccccgacaatccggcccacgacacaggtctactcgatgcggacgccgagagcctcggccgctcgttgggctaccccgtgcgcgccttgcctttgttctcaaaatccgttgctcaggccatcgttcagtgcacctccgaaggccacttcgacggggtgattattggtgcgagccgcgagagcctgctgcgccaggccatccggggcaacatccccgaaaccgtcgccaagggcagcgactgcacggtggtcgtggtgcgcacttag

SEQ ID NO: 104 - protein, 858 aa, Gloeobacter violaceus
MQSWLQNFRQLLRPQRLATLEACLIGLVAGLAAVILKQGADLLSHWRLDAAGSFGWWVLPLLGLLGGVTAGWLVERFAPEASGSGIPQVKAVLARVPMALDLRVALVKLVGTMVTLGSGFPLGREGPTIQIGAALANQLSRWVPTSPAYRRQLVAAGAGAGLAAAFDAPIAGVIFVVEQLLQNVSGLTLGVAILASFIGAVLSRVLGGFSFDLKSSMADFQTGFTVQEIPFYLLLGVMAGVLGALYNRGLIASLTFNRRVLRLNMPLRVGLAGLVMGGSLALLPAVFRDGEALRGLIIGAQEPWQFAALAFVAQFVLTLIAYGSGAPGGVFAPSLVLGAALGSLVGTLSYSTLAVNAPITYSLVGMGAFFCAVTRVPITAVIIIFEITNDFNLVLPLMVVCVVASLVAERLNEGSIYDQLLAWNGIRLGEEAVSDEKLLAQLAAGDVMQTRLETLESTLPLSEVSQAFSRSHHRGFPVVKDEKLVGIVTQTDLMKIAARNLPPTAPLSELMTPQPVTVTPRDSLKEVLYLLNRYELSRLPVVEEAKLVGIITRSDIIRAEADLLSGDTQAVGPRPDPSYVVYQTRAPALGGGRLLLPLANPDTAPALLEFALAIARARNLELECLHVIAVPRTSAPSSTPVAVAPAVNLVRQAVRAGRAVGVPVHTQVRVAHDIAQAVLETVKERRIGLVLMGWRGVNTSPERIFSNTVDTIIRQAPCEVLLVKLKGDAIPRRWLVPIGGGPNAQEAIKILPALLRRGPGKSEIAVCQVFAPDNPAHDTGLLDADAESLGRSLGYPVRALPLFSKSVAQAIVQCTSEGHFDGVIIGASRESLLRQAIRGNIPETVAKGSDCTVVVVRT

SEQ ID NO: 105 - DNA, 2673 bp, Arthrospira maxima CS-328 ctg36, whole genome shotgun sequence
tcaattcataataggtgggcgtaccaaaatgacagtacaaggacaaccacgggcgatcgcttcggggatattacccttaatcgcctgttgcagcatactttcgccactagcacccaaaacaatcacatcacagtaatcatgattagcaatatccaaaagtacatcaaccacagacctagcacaaacagcagttgccaccacctccccattaatggggcttttcaactcctcaactaggtggtctagctttgccatttccgcctcagacaaagcatttttaaccacagttaacagtcggatatcggggcgcaaactcaacctagccaaaccgggtaaaatgcccattgcggctggtggaggtcccccagttcgcagaggaactaaccaacgtcgccaaaccggaaactggagcgatcgctgatctgaggggtcactaaaaatggggttaacattttttccccacttcaccaaaacaacctcaccgggtacttgtcgaataatggtatcaaccacagtgccaaaaacccgattagtggcggacctttccccttgccacccaatcaaagtcaaatcaatatttcgttcttgcacggtctccaaaatcgccccagacacatcatgactgaccctaatttgagtatgaataggaacccgccagcttttggcaatacgttcagcttggcgaagtagacggcgacatttagtaatggataccggagtttccgccggggacaaattgcgagcaatggtaataatagtcaagcattctagctcataattacgttcagcagcgatcgccgccgcaatatgtagcaaagccggggcggtagtgggattattcaaagccaccaatagtcgcccatgaccgaccatggggccgcgagtttgataaaccacataggagggggtggcatgatgccccacctggtgactaccgctaatatatccaagttcaccgcgaataatatcgctgcgggtaataattcccaccaaatgccgcccctcgacgacgggaaggcgactgagtttttgccgtcccaacagatacagaacctcactgaggggagcatcagggtaaatagtaacaggttggggagtcatcagcttatgtaggggggtttgttctgatatgtcttgttggttaatctttgccatatcagtttggctgataataccgaccaatttaccctggttgactacgggaaagccgcgatgatgggattgagaaaaagcggacctaacctgttctagggataactgatcttcgagagtttctacctgtcgctgcataacatccctagcgtgcaacatatttaaggctacccggtcagcattttggtcaggttccaattcaatgccactcaaagccaataggcgatcgtatagggaatctttttctatcttttcggctaccaaataggagaccacagaacagatcatcagtggcagaaccaagttaaaattggtggtgatttcaaagacaatcaccacggcggtgaccggagtccgagacacggcacagaaaaaggctcccattccggcaaaagcaaaagtggtgtgaggttgtaaggcgatcgttgcctcttcccataagccaatagtattccccaaagccgcgcctaaaattagggatggtgcaaataatccacccggcgcaccggaacccgccgccatggtagttagggaaaactgcactacaaaagctagggctgtggttgtccagaggatattacctttgaggatatattctcgcaaaccggcattatctcgaaaagtctctggtagcacagcaataaccatcccacaaattagacccgccacagccatactcaggggtagtcctaatttgagggtatggcggttaaatttctgaaaggtaataattccccgactgaataacaccccaaatactcccgagagaacacccaccaggatataaaaggggatttctaggggttcaattaaccattgttgatatagggcttctgggggtatgtctatggtgggaggtagtcccatggctttgtttcctaatagccgggatactaccgccccagtaaatgaggcgataatggcgggtccgagggttaatcctgagatgtcgtgtaggaggtcttccactacgaataaaaccccggctatgggagcgttaaacccggcggctagtccggcggcggctccacaggcgattagttgtttgcgatagttgggagaagtgggaacccaacgacttacccaggcggcgagggcggctccgatttgtactgttggcccctgtcgtcctagggtgaatccagaagccatggtgatcatggtgctgatcagtttgactactgctacccgtagatctagggaggttttgattccccctagggctgctttaacttgggggataccgcttccggctgcttctggggctatgcgttcgactaggaaaccagacaacagccccccgactacgcctaatatgggtaaaaatagccaagctgaaaagtgggcggaaccttggactcgccaagaccctaaccacccggctcctgttctcagaaaaaaggcggctattcctgaaattaatccgattaagccggcttctaaaatggccagcctttgggaaccgccaattatggatttggcgaggctctggaattgattggttaaggatggccagtacac

SEQ ID NO: 106 - protein, 890 aa, Arthrospira maxima CS-328 ctg36, whole genome shotgun sequence
MYWPSLTNQFQSLAKSIIGGSQRLAILEAGLIGLISGIAAFFLRTGAGWLGSWRVQGSAHFSAWLFLPILGVVGGLLSGFLVERIAPEAAGSGIPQVKAALGGIKTSLDLRVAVVKLISTMITMASGFTLGRQGPTVQIGAALAAWVSRWVPTSPNYRKQLIACGAAAGLAAGFNAPIAGVLFVVEDLLHDISGLTLGPAIIASFTGAVVSRLLGNKAMGLPPTIDIPPEALYQQWLIEPLEIPFYILVGVLSGVFGVLFSRGIITFQKFNRHTLKLGLPLSMAVAGLICGMVIAVLPETFRDNAGLREYILKGNILWTTTALAFVVQFSLTTMAAGSGAPGGLFAPSLILGAALGNTIGLWEEATIALQPHTTFAFAGMGAFFCAVSRTPVTAVVIVFEITTNFNLVLPLMICSVVSYLVAEKIEKDSLYDRLLALSGIELEPDQNADRVALNMLHARDVMQRQVETLEDQLSLEQVRSAFSQSHHRGFPVVNQGKLVGIISQTDMAKINQQDISEQTPLHKLMTPQPVTIYPDAPLSEVLYLLGRQKLSRLPVVEGRHLVGIITRSDIIRGELGYISGSHQVGHHATPSYVVYQTRGPMVGHGRLLVALNNPTTAPALLHIAAAIAAERNYELECLTIITIARNLSPAETPVSITKCRRLLRQAERIAKSWRVPIHTQIRVSHDVSGAILETVQERNIDLTLIGWQGERSATNRVFGTVVDTIIRQVPGEVVLVKWGKNVNPIFSDPSDQRSLQFPVWRRWLVPLRTGGPPPAAMGILPGLARLSLRPDIRLLTVVKNALSEAEMAKLDHLVEELKSPINGEVVATAVCARSVVDVLLDIANHDYCDVIVLGASGESMLQQAIKGNIPEAIARGCPCTVILVRPPIMN

SEQ ID NO: 107 - DNA, 2616 bp, Acaryochloris marina
atgaagctaatctcggcctttcaacccctgcgccacctcactcagtccagtcgctttgccattattgaagcctgtctgattggtcttatttctggtttagcagccgtcgccttgcaggatgggattgggtggttaggggggctacggatatctttggccaaccaatttcattctcctctgatactgccgttaataggggttatcggcggtttaattgcagggttgctgatagaaaccatcgctccggatgcgaaggggagcggcatccctcaagtgaaggctgcactggcacagtttccgattgcgctgaattggcaagtcgcgctggtcaaattgttcagcggcatcactgccctgggaactggattacctctagggcggcaagggcctacggtacaactaggcgctgccctggccgctcagctaagctactggttccctacagctcccaaccaccgacaacaaatgattgcggcaggggcaggagctggactcgcagcagggtttgcggctcccattgctggagtgctttttattgtcgaggagctgctgcatgacttatctggattaaccctggggaccgccattctgtcctcctttatcggtgcagttgttgcccatgttttaggggggcaaaacttatctatcagctttgagcaggtcaccaccgccaccagcttctccgttccggaaattcccttctttattttgctggggattttggctggaggatttggcgctatattcaatcgaggtctgctcctcagcgttgatctaaaccgccgactcaagttccttggattaccctggcgcatcagcttagcaggcggtatttgtggcagcattattggccaactgcccagcattttccaggacaatacggggctcagaggactattgggtttaggagatctgggttggcagttggccctaacagccttcgttgtccagtttggactaaccctgattgcctatggttcaggggctccaggcggattatttgcccccagcctagtcatgggggccgccttagggaatttagtagggctaggtcaggctcaactactcggtgctggtttacccacgacttatgcgtttgtgggcatgggggcgttttttggggccgttagtcgtgtccctgtaactgggatcgtgattatctttgaaatcacccaggatttcaatctcgttctccctctgatgatcagctctgtagtcgcctatctaaccgctgagcaaatcaatcaaagttctatctatgatttgttgctacagcaacaaggcattcaactccaaaatgcatccccctctgcgcaacggatgttagatgccctaacggcagaagacattatgcagcggcaagtggaaacgttacctagcgatctgtctttagatgcagcccgaaagattttttcccgttcccaccatcggggttttccagtgctcgaagaccgacgattagtggggatcttgagtcgtacagatcttaatcgagttacgcaacaacagaaacccggcgataccttaatccgggatatcatgacgccccagcctttaaccgttggtccctcggcatctttgtctgatgtcctgtatattctcaatcgctcccatatcagtcgtctacccgtattagatggacgtaaactcatcggtatcattacccgtgccgatattattcatgctgaatttgatcacatttccggccagaagcaacaggataatcaggcttttgcgccatcctacggcgtctacctaacccgagggcctgccactggcgaagggcgaatcctcttacccctcgcgaatcctgacacagctgaacccctcctaaaggttgctgtagccatggctcaagccctgaactatgagctagagtgcctgcacattatccgtctaccgcgtaatcgtttaccagctgagacccccgtccaaaccgtcaaaggtcggcgacttctgcaaaaagcaattcggtatggccaacgccaccaagtgtctgttcatacccaaatcattgcggctcaggatgtggcccaagccattttggaagtcgaacagacggagcatatcaacctcctgcttatggggtggcaaggacaatttttctccggtggacagattggtaatcccacggttcgaaccatcctccagcaggccaaaagccaagttttagtcattagacctgccacccacttcaatactggtaaaaaccaacgttggcttatcccagtgtctggagggccaaacgtgcaacaagcgattcaacttttgccagccctcgttcccatcagtaagtcacccaagctgaaattgtttcaagtttatccccccagtagtgatctgcccgaccagagtattctcgaacactactcccagttcctcaaacaggcctgcccggatagtgcagtcaaacggacacaaatttgtgctcaaaatgtggcagacgctattgtggaactggcaaggctccaaaagacagacatcatcgttattggagccagcccaactgggttagtccaccaagcactcaaaggaaacatccccctagccattgctcaaggaacagaggcgaccatcattttagtgagaggctctggaaccaacgttgtggtttag

SEQ ID NO: 108 - protein, 871 aa, Acaryochloris marina
MKLISAFQPLRHLTQSSRFAIIEACLIGLISGLAAVALQDGIGWLGGLRISLANQFHSPLILPLIGVIGGLIAGLLIETIAPDAKGSGIPQVKAALAQFPIALNWQVALVKLFSGITALGTGLPLGRQGPTVQLGAALAAQLSYWFPTAPNHRQQMIAAGAGAGLAAGFAAPIAGVLFIVEELLHDLSGLTLGTAILSSFIGAVVAHVLGGQNLSISFEQVTTATSFSVPEIPFFILLGILAGGFGAIFNRGLLLSVDLNRRLKFLGLPWRISLAGGICGSIIGQLPSIFQDNTGLRGLLGLGDLGWQLALTAFVVQFGLTLIAYGSGAPGGLFAPSLVMGAALGNLVGLGQAQLLGAGLPTTYAFVGMGAFFGAVSRVPVTGIVIIFEITQDFNLVLPLMISSVVAYLTAEQINQSSIYDLLLQQQGIQLQNASPSAQRMLDALTAEDIMQRQVETLPSDLSLDAARKIFSRSHHRGFPVLEDRRLVGILSRTDLNRVTQQQKPGDTLIRDIMTPQPLTVGPSASLSDVLYILNRSHISRLPVLDGRKLIGIITRADIIHAEFDHISGQKQQDNQAFAPSYGVYLTRGPATGEGRILLPLANPDTAEPLLKVAVAMAQALNYELECLHIIRLPRNRLPAETPVQTVKGRRLLQKAIRYGQRHQVSVHTQIIAAQDVAQAILEVEQTEHINLLLMGWQGQFFSGGQIGNPTVRTILQQAKSQVLVIRPATHFNTGKNQRWLIPVSGGPNVQQAIQLLPALVPISKSPKLKLFQVYPPSSDLPDQSILEHYSQFLKQACPDSAVKRTQICAQNVADAIVELARLQKTDIIVIGASPTGLVHQALKGNIPLAIAQGTEATIILVRGSGTNVVV

SEQ ID NO: 109 - DNA, 2694 bp, Cyanothece sp.
ctattcagcgctgagggctttgcggaccaggataaccgtgcagtcagagtggcgggcaatttgttcaggaatattcccctgaatcacctgctgcagtaacccttcccggctggcccccagtacaatcacatcacactggtctttttcgactaaatcgacaatggcatcggcaacggagtcagcacaaagggtgagggtgatcacgggagcttgaagttgctggttcagaaaatcggcatcctgctccagtaaggtggtgtcgtggtaaggttctgagggggaaaatacttgacacagccgaatttgggggtgctggctgagggcaaccagggctggtagcaaggtgagagcatactgggcattgggtcctccggcaacgggaaccagccagcgattgagtgtgaacagccgcatgagcagtgtgagggccgattgaccagacaggtctgctgccttggccaggggaagaatcagctgcttgccgggccgaaccagcacaacattacaactggcttcgcggacgatcgtgtctaccaccgtgccaaaaatgcgtcctggggttaacgttaccccctcccaacccatgaggaccagatcgatgtgccgatctcgaatggtttccagaatggccatagcaatatcctgggcaacgcgaatttgggtatggacgggcacctgccaggtttgtcccccagcaaccgcatgttccatcatttggcggctggccgtaatatcgacactggtttcggagggccgactgtggcggggaatcggaataatatgtaaacattccagatcatagtgatgctgttgggcgatcgcggcggccaggcgcaacagggcatcagtggtttggggattactcagcggtaccagtagccgtccctgagctgttgtggaggactgggtttggtacaccgggtaggaaggggcaggtttgactttgaggggactggcttcaccactgagacgatcgcattcagcccggataatatcagcacgggtgataattccgaccagcttgcgtccctccgtcacaggtagacggctgatctgataatggttgagcagatacaggacatgggccaatcgatcgccaggaccaacactgatcaatcgttgggtcataatctgactgaggggtaagtccgggctcagccccctgacgctcactctggccagatccgactgagtgaccatccccactaatctgccatccgccactacgggaaacccgcggtgatgggattgctcaaaaaactgaatcgctgcagcgatcgtcatgtccgccggtaaggtttcgacccgtcgttgcatgatgtcggctgccagtaagccctgcaactgctgatccccggcgaacttttgatccagctgaatcccccgtaactctaacagatgggtataaatggagcctttggataccttttcggccaccaggtaggccaccactgagccgatcatcaaaggcagtacaacatcaaagtccatcgtcagctcaaagacaatcacgatcgctgtgatcggcccgcgggttacagcactaaagaatgcccccatgcctgtgagggtataaatgaccggcgcttgggagaggacggttccattcagctccagttggactccttgagccatctggccaatcaatccgcctagggccgaacccagaattagggagggtgcaaataacccaccgggaacccctgaaccgtaagccagcagcaccagcagaaatttgccgacaaaggcgatcgcggtgatctgccagccaatctcccccagaaccagcaaatcctgagtgccactactagaccgcagaatcgggggtaaaaacgccaggatcatcccactgattgcacctgccagccccatttgccaggatggccgccagcccggtaggtattgccggtaaaagcgcaaactggtcaaaatcccacgattaaagctggcccccagcaccccagcgatcgctcccagcagcatcaacaccggaatatccatgagcgtaaagctcagatcgatcccactcagatcgggaattaagcctcttccccccagtaaacgggaaacaacccccccgacaaaggccgccagaatagccgtgcccagtgttagttccgataaatcctgaagtaactcttcaatcacgaatagcaccccagcgatcggcgcattaaatccagccgctaaacccgctgctgcccctgcggctattagttggcgttgataagccggtgaagtagctaaccagcggctgaactgtccggccagtgccgctccaatctgtacagtgggtccctgtcgccccagggccaggccagcccccagcgccagagttgtactgaccagtttgactacagccacccgcagatcgagggcgatcgaggcatagcccagggccgctttcacctggggaattccactgcccgtagcctccggggcggcccactcaatcaaccagccactcagtagcccccccaacagtccgatcaccggcaaaatcagcaggggaggcagatctgcaccgatcgctgccgtccagctttccattgcggcgatcgcctgcttcaacaaaacggcagccagcgccgagaccaacccaatcaaacaagcttctaagatggcaacagatttggggcggagtaagcgttgcagggattgggtcagccagatggttcctttcataagggccat

SEQ ID NO: 110 - protein, 897 aa, Cyanothece sp.
MALMKGTIWLTQSLQRLLRPKSVAILEACLIGLVSALAAVLLKQAIAAMESWTAAIGADLPPLLILPVIGLLGGLLSGWLIEWAAPEATGSGIPQVKAALGYASIALDLRVAVVKLVSTTLALGAGLALGRQGPTVQIGAALAGQFSRWLATSPAYQRQLIAAGAAAGLAAGFNAPIAGVLFVIEELLQDLSELTLGTAILAAFVGGVVSRLLGGRGLIPDLSGIDLSFTLMDIPVLMLLGAIAGVLGASFNRGILTSLRFYRQYLPGWRPSWQMGLAGAISGMILAFLPPILRSSSGTQDLLVLGEIGWQITAIAFVGKFLLVLLAYGSGVPGGLFAPSLILGSALGGLIGQMAQGVQLELNGTVLSQAPVIYTLTGMGAFFSAVTRGPITAIVIVFELTMDFDVVLPLMIGSVVAYLVAEKVSKGSIYTHLLELRGIQLDQKFAGDQQLQGLLAADIMQRRVETLPADMTIAAAIQFFEQSHHRGFPVVADGRLVGMVTQSDLARVSVRGLSPDLPLSQIMTQRLISVGPGDRLAHVLYLLNHYQISRLPVTEGRKLVGIITRADIIRAECDRLSGEASPLKVKPAPSYPVYQTQSSTTAQGRLLVPLSNPQTTDALLRLAAAIAQQHHYDLECLHIIPIPRHSRPSETSVDITASRQMMEHAVAGGQTWQVPVHTQIRVAQDIAMAILETIRDRHIDLVLMGWEGVTLTPGRIFGTVVDTIVREASCNVVLVRPGKQLILPLAKAADLSGQSALTLLMRLFTLNRWLVPVAGGPNAQYALTLLPALVALSQHPQIRLCQVFSPSEPYHDTTLLEQDADFLNQQLQAPVITLTLCADSVADAIVDLVEKDQCDVIVLGASREGLLQQVIQGNIPEQIARHSDCTVILVRKALSAE

SEQ ID NO: 111 - DNA, 2580 bp, Synechococcus elongatus
ttaacgtctctgaatgattacggtttgcggtgcctgtgctaacagatctttccagagggttgtggtgggcagctgttccaaggtcatcgatagcatcaccgcttcgatccctcgactttgcatcacatccaatagcactgctgtcaccgatcgcgcacagatcaagtctgcttggatgggttgccgcaggcggttctccagtcgtcgctgcagctgctggagacggttggctgaaacggtttgtcgagggaggtcgatctgacagagggagatatctggatcggtaatcaactgcaggatttgttccaagggctcggccaaacctgtctggggcacctgggcgctgaggggaatcagccaatggcgtagcggcagagtcgggcgatcgccctgcaggagtggcgccttggccaggaatgcagccccgggtttgaccaacagcacccggcagggagcctgctgcaaaatctgatcaatcccttcgcggaacagccgttgggctaaggaagccccgccaccccagcccatcacgagatcgttgatgtggcgatcgctaatcgtttctagaatcgcagcagaaagatcgtgacaaacccggacttgcgtatgaaccggaatctgccagcgtcggcccaaccgctcggcctgccgcaacattcgccgtgctccaagagttgaaactgctgtttgagagggatcggcttcgcgagagacaggaatcaggtgcagacattccagctcgtagttccgcaaactggcgagccctgccgccaactgcaacagagattgagctgtgcgcggattggccagtagcactagcagacgtccttggccggtagcgggcgatcgcgtttcgtaggcgacgtaggagggggcgatcggcgtcgcagcaatatcttgaccgcttaggagttccgattcggcccgaatgatgtcggctcgtgtgatgattccgaccagcttgcggccatcgaccacgggcaaccggctgatttggaagcggttcagcacgtaaagaacgtgggccagagtgtcttggggggcaactgtcagcgggtgaggcgtcatgatttcgctgagccgcacggactcgcctttgcctttgagggtttgttcatccagatcggagctggtaacaatgccgactagagcacctttttgagtaacaggaaaacctcggtggtgagtgcggttgaattgctggattacttcagtcaggggtaggctggcttccagagtttccacaggactagccatcacctgggcagcagtcagacccaagctgctgttgagagttggcaaggcgtcaaccactgcggctgctttgctgggcgatcgcgccaagctggcaattccataggcggtaatcgaggccaccatcagcggtaacactgcgttgaaatcgcgggtcatctcgaacacaatcacgatcgccgtgatcggcccttgggtgacggcgctaaacatcgcgcccatacccgccaaggcataggttgccggagcatcgatccgcagcggaatcccaacctgcaaaaagatcgcctgaatggaaagcaccacgcccagacccaaactggaaccgagcaccagcgctggcgcaaaaatcccgccagaagcccctgatccagcagccaccagcgtcagaccaaagttgatcgccaacatcagcaacgcgatcgagccactgtccgggatggtcaccctaaaggggttactcaggccttgccgcagcgcagcagggagcaacagcagtagtaaggccgagatcccactggcgatcgcaacccgccaaggcagccccttgagcggtaagcgttcataacagcgttgactgaacgccaagccgcgattgaacaaaatgcctaggccccctgcaaacagtcctaaaagtaggacaacgggcagctcaggcacggtcagggcggctggagcagcaacaatttcagagctgaaactcaggctttgactgccgagaattcccgaaacaactgccccaataaaggctgcgaggactgctgtcccaagggtgaagctagagacatcatggagcagttgctccagcactagcatcacaccggctagcggtgcattaaagccagccgcgaggccagcggcagccccggaagcaatcaactgtcgtcggtagtctggcgaggtggggaaccactggctcatctgacccgcgagggaagcgcccacttgcacggttgggccttgccgccctaggggcagccctgaaccaaccaccagcatcgtgctggcaattttgacgatcgcaacccgtaggttcaaggcgatgcggctgcctgacagtgcggcttgcacttggctgatgccgctgccctcggcttcgggggcaaaccgttgcaccagccaaccggcgatcgcgcccagaatcggtggcaaaaggagctgcaggccaagtggcagtcccgggcgatcgcgcagatcttgaacacccgttgcacccagtttgagcaggaaggcactcgcccctgaaaccagcccgattgcgcaagcttccagcacagcccactgctgcgctttagcaaaccgtggcggaaaacgcagacgaaacac

SEQ ID NO: 112 - protein, 859 aa, Synechococcus elongatus
MFRLRFPPRFAKAQQWAVLEACAIGLVSGASAFLLKLGATGVQDLRDRPGLPLGLQLLLPPILGAIAGWLVQRFAPEAEGSGISQVQAALSGSRIALNLRVAIVKIASTMLVVGSGLPLGRQGPTVQVGASLAGQMSQWFPTSPDYRRQLIASGAAAGLAAGFNAPLAGVMLVLEQLLHDVSSFTLGTAVLAAFIGAVVSGILGSQSLSFSSEIVAAPAALTVPELPVVLLLGLFAGGLGILFNRGLAFSQRCYERLPLKGLPWRVAIASGISALLLLLLPAALRQGLSNPFRVTIPDSGSIALLMLAINFGLTLVAAGSGASGGIFAPALVLGSSLGLGVVLSIQAIFLQVGIPLRIDAPATYALAGMGAMFSAVTQGPITAIVIVFEMTRDFNAVLPLMVASITAYGIASLARSPSKAAAVVDALPTLNSSLGLTAAQVMASPVETLEASLPLTEVIQQFNRTHHRGFPVTQKGALVGIVTSSDLDEQTLKGKGESVRLSEIMTPHPLTVAPQDTLAHVLYVLNRFQISRLPVVDGRKLVGIITRADIIRAESELLSGQDIAATPIAPSYVAYETRSPATGQGRLLVLLANPRTAQSLLQLAAGLASLRNYELECLHLIPVSREADPSQTAVSTLGARRMLRQAERLGRRWQIPVHTQVRVCHDLSAAILETISDRHINDLVMGWGGGASLAQRLFREGIDQILQQAPCRVLLVKPGAAFLAKAPLLQGDRPTLPLRHWLIPLSAQVPQTGLAEPLEQILQLITDPDISLCQIDLPRQTVSANRLQQLQRRLENRLRQPIQADLICARSVTAVLLDVMQSRGIEAVMLSMTLEQLPTTTLWKDLLAQAPQTVIIQRR

SEQ ID NO: 113 - protein, 10 aa, Artificial sequence
  motif 9
  VARIANT (2)..(2): / replace = "Ser"
  VARIANT (3)..(3): / replace = "Ile"
  VARIANT (4)..(4): / replace = "Gln"
  VARIANT (5)..(5): / replace = "Val"
  VARIANT (8)..(8): / replace = "Ser" / replace = "Gly"
PTVHIGAALA

SEQ ID NO: 114 - protein, 16 aa, Artificial sequence
  motif 10
  VARIANT (1)..(1): / replace = "Ser"
  VARIANT (4)..(4): / replace = "Leu" / replace = "Val"
  VARIANT (5)..(5): / replace = "Leu"
  UNSURE (6)..(6): Unknown amino acid
  VARIANT (8)..(8): / replace = "Ser" / replace = "Thr"
  UNSURE (10)..(10): Unknown amino acid
  VARIANT (11)..(11): / replace = "Met"
  VARIANT (13)..(13): / replace = "Ala" / replace = "Thr"
  UNSURE (14)..(14): Unknown amino acid
PGGIFXPALXLGSXLG

SEQ ID NO: 115 - DNA, 1264 bp, Oryza sativa; identical to SEQ ID NO: 50

SEQ ID NO: 116 - DNA, 54 bp, Artificial sequence
  primer 1
ggggacaagtttgtacaaaaaagcaggcttaaacaatggcttggtttccctttt

SEQ ID NO: 117 - DNA, 52 bp, Artificial sequence
  primer 2
ggggaccactttgtacaagaaagctgggtttactcgtctagaccgaaatctg

SEQ ID NO: 118 - DNA, 2940 bp, Synechocystis sp.
ttaattgggaaatttaatgtaacggttccgcttcataaatgcggcgactttgagccaattttttgcttccttttcccaattcttctggctagtagtctgccaaagttgaattaaaaaacaagctaaacgagacctcaaagtcgattgttgatccttgtcgagggcatcacgccgctctaccaaaacatttacccagggcataattgcttcccgcaccggaatgggatgctgttctaaaaccgtagcggcggtttcgtaggtggaagcatcaatggtttcaatatctagtaaatccttccatgtcttaaatacttcaaatttgctggtggcggtcaaaacattaccgttgccgtaaataacccgtacttgtactgcatccttggattttttatcttctccttctccatactcatgttctttggcttcctcttccgcttcccaaagatgctccaaggcgatcgccagggggacagagtggtgggcaatggtaatgccaaagctaatggtggccccatcccccatggtaaacaagggccgttggggcaagtttttgtgggcagtttttgagtgccaataatgccccgtgctgtcaaattccctgtgttcatcgcgatcgccacgaaaggcttggcgaatgtcccacaaccattgatcccattcccacaggttggtgtaggccagtacatcgtctccgccgctataaattaatctgcctgcatatctttgttcggtgaggtagggcaccaattggttggagaaatccagcagggctcgactcagggcgttatgggtagcagggcccatccgtttaggctgttcgctaaagggttgaaaagttggctgtaggtcttccggcacagttaaaacctggggaaaataatcgccgtaggttctcattttggtgcccttgagccattcgctcatgccatccccatccccagcagctaaaacgtaccaactagtgggattattctggggataaaatttttcgatttctgtttgcaatgcttggcgataactaggcaactctgtttggtcgagatcttccaattcttccaccaaccaacccgaatttagtagccggggatgatattttttctccatgttttcttcgacccagggaattccccaatcttgggtgacagaatcggccactttatggcgatcgccaaggattttttgggagatggcggagcaggcctgctcaaaaatcggtagaccatccggttgggtttttaaatatcccgctatgcccaccgtaagatctgggtaataggtttttaattccttggccccccgtcccagtaatgcaggcaatactttttccaaaccccgcttcactgtttccgtggcatttaactgttcactgccatcaaataaccctgcctgtcgttgccaatatttttgtgtatctccctctgtgacccaatcccgttggtgactaggggcttggggatggaccactggcccaaggccggaaatggtggaccgggggccaaaggcggtgggaattttccagttgcgagcatttttaaccgcactaagggtaaatctggtttggccaaagatatctgcccaccaggaacccacattcaagctaccggcatagttgcggttccgttgctggataaacaaatccgtggatttttcgataaagtccaattcttcctgggcaaataaactagcggaaaatgcttcattttgttccctaacccattggtctcgttgggctttactttccggtgtttgggtgggaatgcccacactttttagggtttttccctccgccccgatcgccatggcgctccaataggtctgccactgggcatccagccaatgtttccaggtgggatcagttgggtttaactgtttttgccaatgtcgttgttgcaattctgcaaagactaaatgggcaatatttcgccaagcgtttagtagatgatttttggccgattgcatggcggcgctaactttttctttgggcagtaccaacataattacgttgggaaatcccgctgttaacagttggcgatcgcctggctggggtacccactgactaaagccttgctcaccatatttttctagtagccaatggtcgatcaagggttgaccgtacaggctggggtacaggaaacaatcggggccatactgctgggccaattcccaacaaactttggcggacaggtagtgcaatatccaagacccagcccaaaagtctttgattttacggctggctttaattagttcttgaatggggctaaaggtgaatacggccagataagcttgggatttgggtgtatttcttgctcctttggcaatatcttcaatgttggtgtcatagcccgccaatgctccggctaaggcggctgtcatactgccatggctccaaatggaagcatcgggcaaacgggtttccgctggcattaacaagctctctgggccaaattgttcggccactgcttcgggcaaacatcgccataaccaccaaaagcattcctgggctttgtctgtaccatggagaaattccgctggcatttgctggatcagttctaattctttttgctctaaataagtacggcgattaccttggccaataatttcgctatgatttgctagttttaatggcaacttagccccggataggagatgggaaagttcgagccctttgccgtcatagtctatgggcgtaccaatatagtgaatggctccccgatcgctggcggaagcgattagatcggataaaccaatatggtcaagccaactattgctcagttcaccgtcttttttttctgtgctggatttgggtgacacccagttttgcatacagcccaaggactgccaagctccctctcctcctctgccagagttgttatgtaaagctttgagggcggggtcgtggagtagcccccaaatttttgcttgccagtaaacttcagacac

SEQ ID NO: 119 - protein, 979 aa, Synechocystis sp.
MSEVYWQAKIWGLLHDPALKALHNNSGRGGEGAWQSLGCMQNWVSPKSSTEKKDGELSNSWLDHIGLSDLIASASDRGAIHYIGTPIDYDGKGLELSHLLSGAKLPLKLANHSEIIGQGNRRTYLEQKELELIQQMPAEFLHGTDKAQECFWWLWRCLPEAVAEQFGPESLLMPAETRLPDASIWSHGSMTAALAGALAGYDTNIEDIAKGARNTPKSQAYLAVFTFSPIQELIKASRKIKDFWAGSWILHYLSAKVCWELAQQYGPDCFLYPSLYGQPLIDHWLLEKYGEQGFSQWVPQPGDRQLLTAGFPNVIMLVLPKEKVSAAMQSAKNHLLNAWRNIAHLVFAELQQRHWQKQLNPTDPTWKHWLDAQWQTYWSAMAIGAEGKTLKSVGIPTQTPESKAQRDQWVREQNEAFSASLFAQEELDFIEKSTDLFIQQRNRNYAGSLNVGSWWADIFGQTRFTLSAVKNARNWKIPTAFGPRSTISGLGPVVHPQAPSHQRDWVTEGDTQKYWQRQAGLFDGSEQLNATETVKRGLEKVLPALLGRGAKELKTYYPDLTVGIAGYLKTQPDGLPIFEQACSAISQKILGDRHKVADSVTQDWGIPWVEENMEKKYHPRLLNSGWLVEELEDLDQTELPSYRQALQTEIEKFYPQNNPTSWYVLAAGDGDGMSEWLKGTKMRTYGDYFPQVLTVPEDLQPTFQPFSEQPKRMGPATHNALSRALLDFSNQLVPYLTEQRYAGRLIYSGGDDVLAYTNLWEWDQWLWDIRQAFRGDRDEHREFDSTGHYWHSKTAHKNLPQRPLFTMGDGATISFGITIAHHSVPLAIALEHLWEAEEEAKEHEYGEGEDKKSKDAVQVRVIYGNGNVLTATSKFEVFKTWKDLLDIETIDASTYETAATVLEQHPIPVREAIMPWVNVLVERRDALDKDQQSTLRSRLACFLIQLWQTTSQKNWEKEAKNWLKVAAFMKRNRYIKFPN

SEQ ID NO: 120 - DNA, 2952 bp, Synechococcus sp.
ttaaactttgcgagtacgaagattaaaggctgcggctttgagccagtttttggattctttatcccagtcatctgcgttggtcgtattccacagttcttgcaaaaagtgagctaaatatttttgcaagccgattttttgttcttcgttaaggttgctacgccgctccacaaaagcactgacccatggggcgatcgccactgaagtcggaataggatgctgttctaaaagggttgccgccgtttcaaaggttgaagcttccagacctgtgatttctaagagttgttgccacgctcggaaagtatcgaatttacaggttgctttgaggatattgccattgccatagatcacccgcaactgcaccgcatctttctttttctttctctccttaccttctagggcgaaatcttcatattcatgatctttagctccttcttctgcttcccagagattttcgagggcgatcgccaagggaacagaatgatgggcaatgactaaaccaaaactaatagttgcattcttgcccatggtaaaaagagggcgatcaaaccgatcggcttgccagtaatgaccttgattattaaattcaccacaatcgtctttatctcctcgaaaagcttggcggatatcccaaagccactgatcccattcccatagatttgtataagccaggacatcatcaccgccgctgtaaatcaagcgtccggcatagcgttcttcagtgaggtagggggcaagtttattagaaaagtcgaggagggcacggcttagggcattgtgggtggcggggcccatccgttttgcttcgtcgctaaatttgtcaaagcttttttttaaatcattaggaacattgagagctttggggaaatattctttgtaggcttccatctttgttcccttcaaccaatcgctcatcccatcgccatctccagcggcgatcgcataccaactggcgggattattttggggatagaatttctgaatttcgttctgtagatcctgacgataaactttttgagcttccttatcgaggttttctaactcctccacaagccagcctgcatttaatagtcttggatggggcaaattctcaaataacggatcatgagtctcatcaatccatggaatgccccactcttgccggacaaaattcgcgatttcatggtggtctgccgtaatttttgtcctaatcgcacgacaagcatcttgatattgatttaaagcttctccatttttctcactttgggttttgaggtaacccgcaacgccgacggttaaatcaggataataagcctttaattcggtcggatctcgatccaatagtttgggtaaaactttttctaaaccgcgcttaacagtttcagtggcgttgagttgctcgatcccatcaaacaagcctgcatcccgttgccaataatgttgcgcctctccctcagtgagccaatcacgatgttggccattgccttggggatggacgacaggccctaaaccagagatcgtagagcgggtgccaaaagcggtcggcagtttccagttacgggcatttttaacggtattgagggcgagacgagtctgcccacaaatatctgcccaccatgagcctgcgtttaagctgcctgcataattacggttgcgttgttcggtaaattttgctgtcgctttctcaaaaaagtcccgttcagtatctgtgaaaagcttgccattaaaggctttattttgttgttcgatccatttttcgagatcagcctttttgtctgaagtctgggtaggaatcccaacactcttaaagctgctatttttatcaccgatcgccaccgcactccaataggtttgccattgggcatcgagccagcctttccaactgggatctgtatcgctcaggtttgtttgccaatggcgatcgccttgtaattctgcgaggacttccttcgcaatttcgcgccatgcatcaagtaagaaattctttgctgattgcattgctgcagctacttgggcttccggtaacaccaacatgatgacgttgggaaatccggcagtgagcagttgacggtcatctggtggctggatccagtcctcaaattctgaatgtttttgcaatagccaatgatcaattagcggttgtccataaagactgggatagagaaaacaatctgcgccgtatttgtgggccaatcgccagcagactttcgcagaaagataatgcaaaatccatgaccccgcccaaaagtccttcattttacgactggctttaatgagttcctggacgggactaaaggtaaacaccgccagataagggtgagatttcggggtattttgaccaccttttgggatatcgtctaactcggtatcgtatcccgctaaggctccggctaaggcagcagtcatactggcatgactccagatcgaaccgtcaggtaagcgagtttcggcgggcattagaaaacttgctgcgccaaattcatcagcgacagcttggggtaaacagcgccatagccaccagaaacaagcctgggcagcttcaggatcgtcacgaatttcggcgggcatttgatcaatgagatcggcttcagtctgttctaggtaagtttttctgctgctctgcccaaggatttcagcgtggttttggagtcggaggggcaatttctccccagataggaggtgcgataactctagaccttctgcaccgtagtctacggctgtgccgatgtagtggataatgccgcgatcgctggctgaagaaatgagatcacataagccgacatgatctaaccatgtgccactaagctcagatgcttgtttttcctcgctcgatttcggagaagcccagccttccatacaagcaagctttttccataacccttcttcgccacgccccggattcccatagagtgctttgagggcgggatcatggagtagaccccaaatttttgcttgccaatatgctttacctgccac

SEQ ID NO: 121 - protein, 983 aa, Synechococcus sp.
MAGKAYWQAKIWGLLHDPALKALYGNPGRGEEGLWKKLACMEGWASPKSSEEKQASELSGTWLDHVGLCDLISSASDRGIIHYIGTAVDYGAEGLELSHLLSGEKLPLRLQNHAEILGQSSRKTYLEQTEADLIDQMPAEIRDDPEAAQACFWWLWRCLPQAVADEFGAASFLMPAETRLPDGSIWSHASMTAALAGALAGYDTELDDIPKGGQNTPKSHPYLAVFTFSPVQELIKASRKMKDFWAGSWILHYLSAKVCWRLAHKYGADCFLYPSLYGQPLIDHWLLQKHSEFEDWIQPPDDRQLLTAGFPNVIMLVLPEAQVAAAMQSAKNFLLDAWREIAKEVLAELQGDRHWQTNLSDTDPSWKGWLDAQWQTYWSAVAIGDKNSSFKSVGIPTQTSDKKADLEKWIEQQNKAFNGKLFTDTERDFFEKATAKFTEQRNRNYAGSLNAGSWWADICGQTRLALNTVKNARNWKLPTAFGTRSTISGLGPVVHPQGNGQHRDWLTEGEAQHYWQRDAGLFDGIEQLNATETVKRGLEKVLPKLLDRDPTELKAYYPDLTVGVAGYLKTQSEKNGEALNQYQDACRAIRTKITADHHEIANFVRQEWGIPWIDETHDPLFENLPHPRLLNAGWLVEELENLDKEAQKVYRQDLQNEIQKFYPQNNPASWYAIAAGDGDGMSDWLKGTKMEAYKEYFPKALNVPNDLKKSFDKFSDEAKRMGPATHNALSRALLDFSNKLAPYLTEERYAGRLIYSGGDDVLAYTNLWEWDQWLWDIRQAFRGDKDDCGEFNNQGHYWQADRFDRPLFTMGKNATISFGLVIAHHSVPLAIALENLWEAEEGAKDHEYEDFALEGKERKKKKDAVQLRVIYGNGNILKATCKFDTFRAWQQLLEITGLEASTFETAATLLEQHPIPTSVAIAPWVSAFVERRSNLNEEQKIGLQKYLAHFLQELWNTTNADDWDKESKNWLKAAAFNLRTRKV

SEQ ID NO: 122 - DNA, 2988 bp, Synechococcus sp.
tcatcggccgttcctccccaatttcacggtgcggttgcgcagcacaaaagccgccagcttgaaccagtttttgatctccagatcccactcctggggctgggcgggcaggctgtgctgccaaaaatgctggataaactccacaagcttgttctggaagtgctctttctgctccgattcctgtttgaagagatcccggcggctgcaaaagagcgtggcccaggctggcaccgcctctgggctgggggcaggatgttgctcccacagttgggctgcctgctcaaacaaggagctttgatcctgctgctggcccatgagcttccagtcaaaatcaaggagatccttccacttgtcgaacgtgtcgaacttgctggtgctcaccagttggttgccattggcaaacagcacccgcacctgcacgctgtctttggggcagccatgggcatagaggtggcccttggcttcttcttccgcctgccaaaggttttccagggcaatggccagaggcaccgagtgatgggcaatcaccacgccgaagctgatggtggctgcggatcccagggtaaagagggggcgccggctcaaaccttcgggaggccgcccttttttccactgccagtagtcccccaggttctcaaactcccgccagtcatcctctcccccccggaaacactggcgaatatcccacagccagccatcccactcccagaggttggtgtaggccaaaacgtcgtccccgccggcgtagatgagcttgcctgcgtagcgttgctctgttaggtagggcaccaactggccggaaaaatccagcagggcgcggcttagggcgctgtgggtggcaggccccatgcgcttgcggctgtttttgacaaacttctgaaaagcgtctttgacttgctccagctcctccttgtccttgccaaagacctcgccaatggcttccgtttgcccgttggccagccgctgtaggggttgaggcagatagtcgtagtaggatttcatcttctcgcccctgagccatttgcccatgtcgtccccatccccggcagccagcacgtaccaactggcggggttaacgctggggtagtagcggcctagaagcgtctcgatgtcctgccggtagcttctttgcgtttcctcgtccagctccaggtcttccaccagccaaccggcattgagcagacggggatggtagcgcaggttctgccggtcggcccacgggatcccccatttgccccgcatttcccgcagcacccctctgacctccgggtagcgggcctccactgcctgacaggcctgctcgaagtgctctcgttcccgtcgcccttgggttttgaggtagccggctacgccagccgtgagatccgggtaggaagcggcaatctggtcttcatccagctcgcggaagagctccggcagcactttgtacaagccccgcttgagggtttcggtggcattgagctgttcccggccatcgaagagcccggcctgccgttgccaaagccgccgactctccccttctgttatccacccctgccgcggtgagggatgcaccaccggccccaagcccgaaacggtgctgcgcggcccaaacgcaacggggagctgccaatcgcgggcctgcttacaagcggcttgtagccgccgactttgctccactgcggctgcccaccaagatcccacgttgagtccggccttgtattggcggcgctgttgtctttggggatcccagaagctaactcgcaagaactccagctcctcatccccgaagagcttttgcttggcctctaggtgatgggtgcggttttgggcactgacccagggatccgcatcaatggaaacctgagggggcctaaggatgccggtatccttgagggcatgagccggggatcccaggggcacggctgcccagtagtgctgccactggtgctccagccatccctgccaggtgggatcctctgggtgcaactgcctcagccagcggcgatccgcctgcaggtgatccagcaccctctgggccaactgcttccattcttccttgagggtctgctgggcaaactgcatggccgcctccacccgctcttctggcagcagcagcaggagcacattgggaaagccggcggtgagcagggcgttaggcgaaggctgagggatccattcttcaaattcggggtacttctcccgcagccagtagtcgattaatggctggccatagaggctggggtagagcagacagtcggggccgtatttctcggcaagccgccaacttatgcgagcagaaaggtagtgcagcagccaggagccagcccagaagtcccgcattttgcggctggctttgatcagctcctggatggggttgaaggtaaagctcaccaagaagggacgcgcgaacttgggctcgtcgtagccggccaaacatccggccaaggctgcggtgacgctggcgtggctccacagggatccgtctggcagccgggtttctgccggcaacagcagcaagctctcatccccaaactcctgacaaatagcttggggaaagcaccgccaaaaccaccaaaacactttttggggatccgtctcctgccgaacccaatcagggatggcgttctcctcccgttccatcaggtagtctgcacgggagtgggcattcttgagggcttggtgttgctcattggccaattgccaaaagtgcttgcgccccgagagcagatggctcatctccagtccagagcctaacccctggccgcgatcctcaacctggtagtcgatggctacaggcaaatggccaatggccgcgcggtcgctggccgaggcgatgagatcagcatcgcctatgggagaggatccctcggctttgggagaagaccatccctgcatcgccgccagtctggtccacagcccttccttggagcggccagtcctgtcgtgtagggctttgagggcgggatcatgtaacagaccccagagcttagcttgccagtagtaagacat

SEQ ID NO: 123 - protein, 995 aa, Synechococcus sp.
MSYYWQAKLWGLLHDPALKALHDRTGRSKEGLWTRLAAMQGWSSPKAEGSSPIGDADLIASASDRAAIGHLPVAIDYQVEDRGQGLGSGLEMSHLLSGRKHFWQLANEQHQALKNAHSRADYLMEREENAIPDWVRQETDPQKVFWWFWRCFPQAICQEFGDESLLLLPAETRLPDGSLWSHASVTAALAGCLAGYDEPKFARPFLVSFTFNPIQELIKASRKMRDFWAGSWLLHYLSARISWRLAEKYGPDCLLYPSLYGQPLIDYWLREKYPEFEEWIPQPSPNALLTAGFPNVLLLLLPEERVEAAMQFAQQTLKEEWKQLAQRVLDHLQADRRWLRQLHPEDPTWQGWLEHQWQHYWAAVPLGSPAHALKDTGILRPPQVSIDADPWVSAQNRTHHLEAKQKLFGDEELEFLRVSFWDPQRQQRRQYKAGLNVGSWWAAAVEQSRRLQAACKQARDWQLPVAFGPRSTVSGLGPVVHPSPRQGWITEGESRRLWQRQAGLFDGREQLNATETLKRGLYKVLPELFRELDEDQIAASYPDLTAGVAGYLKTQGRREREHFEQACQAVEARYPEVRGVLREMRGKWGIPWADRQNLRYHPRLLNAGWLVEDLELDEETQRSYRQDIETLLGRYYPSVNPASWYVLAAGDGDDMGKWLRGEKMKSYYDYLPQPLQRLANGQTEAIGEVFGKDKEELEQVKDAFQKFVKNSRKRMGPATHSALSRALLDFSGQLVPYLTEQRYAGKLIYAGGDDVLAYTNLWEWDGWLWDIRQCFRGGEDDWREFENLGDYWQWKKGRPPEGLSRRPLFTLGSAATISFGVVIAHHSVPLAIALENLWQAEEEAKGHLYAHGCPKDSVQVRVLFANGNQLVSTSKFDTFDKWKDLLDFDWKLMGQQQDQSSLFEQAAQLWEQHPAPSPEAVPAWATLFCSRRDLFKQESEQKEHFQNKLVEFIQHFWQHSLPAQPQEWDLEIKNWFKLAAFVLRNRTVKLGRNGR

SEQ ID NO: 124 - DNA, 2563 bp, Cyanothece sp.
ttaagcttttcctcctaatttaattttacggttgcgaagaacaaaagctgttagtttgaaccaactttgaacgtcttgatttaattgctcctctgaagtatttgtccacaaatcttctataaattttgatagggctgtttgaaagctttttctgatgtcatcattaagggtttctcgacggctacaaaaagcaactgtccaaggtttaatcgcctcttgaataggaataggatgttgagtccaaagggtggcggcttgttcaaataagctggcttctaactcatttattctgagtaattttttccattgttcaaacacttcaaatttgctagtggcttttaggatattaccgttaccataaattactctcacttgaacggcatccttataagttttatggttattttcgttaatgtaatgttctttggcttcttcttctgcttcccaaagattttctaaagcgatcgctaaaggaactgaatgatgagcaataacgattccaaaactaattgtcgcattttgacccattgtgaataagggacgctctgctaaatgattgggtttattttcttggttccattgccaataatttccttcgtttttaaattcacttttttctaaattaaatgtcccatcattattaaatcctagtggatctttatctcctcgaaaacattgacgtatatcccataaccaattatcccattcccataaattagtataagctaaaacatcatctcctccactataaattaatcgtcctgcatacctttcttcggttaaataaggaactaattggttagaaaaatcaagcaaagcacgacttaaagcattgtgagttgatggccccattcgtttaggtacggttaaaaattcgttaaaagcttctgcaatatctccttctacatttaagttttcaggagtgtaatgtccataagattttagtttgccacctttcaaccattcactcattccatccccatcaccagcagcaattatatagcaatcagtgggattattactaggataataatctttgactaatttttgtaatttaagtctattttcagccgtcgattctttttctaaatcttcgactaaccatcctgcattaagtaaacgaggatgatatttaatagtaggattagtatctgcccaaggaatcccccatttgtctgttatttcatcaggaattttattatgttctgctaaatattcgttaataactgctttagaggttttttcaaaatgttctaaatcttcacttgtgccatttttcaaatatccggccattcctgcggttaaatcaggataactcatttgaattttatcggcttctaattctaataatttaggtaaaactaaatgaagtcctcttttaactgtttctgttgcattcagttgttcaattccatcaaataatcctgcttgtcttttccataaagcttttgtttttccctcttcaatccaatcatcactaggatgaacaacagaacctaatccagaaattgttgaacgggtactaaaagctgttggtatttgccaatctctaccattttttacggcggttaaagctaaacgagtttgatcaaatatagctgcccaccaagaacctatattagtattaaaaggatatttgttttgctggtcttgacggagtttggctgctttttgtaaaaaagttaattctttttctaaaaataaagccgtattttcatttaatccataagcttgattttgaatggctacccaactacgatctttttcaataatttcactatctttaatttcttcattttctcgataaatttcactactggttaaggcaatcttttctaattgaccttcttgatcttcctgttttttatcaactccaataggaaccgccgtccaataggtttgccattgagattttaaccatcctttccaagttttatggtcaaaagatagtgacttcatccagtatctttcttctaactcactaaagactaatttgctaatatttaaccattcactaattaaggtacttttagctgtttgcatagcagtttctactttatctttgggaagtaccaagacaagtacattaggaaatcctgccgttaataaactgcgttgacttggttgcttaatccattgattaaatccgaatttactatatttttgtaataaccaatgatcgattaaaggttgttgatataaattaggatatataaaacaatccggtccgtaaatattcgctaatgtccaagaaactttggcagaaagatagtgtaaaatccaagaccctgcccaaaaatctcgcatttttcgactagctttgattaattcctgaataggggaaaaggtaaaactagctaaataaggatgggataaaggtttattggcttccccattttgagttaaatcttctgttgttaaatcataccctgataatgctcctgccatcgctgcggtaagactagcatgactccaatgtgaactatcgggtaaacgggtttctgctggcattaataatagtgaagcatcatcaaataattgacaagttgcttcgggaagacat

SEQ ID NO: 125 - protein, 853 aa, Cyanothece sp.
CLPEATCQLFDDASLLLMPAETRLPDSSHWSHASLTAAMAGALSGYDLTTEDLTQNGEANKPLSHPYLASFTFSPIQELIKASRKMRDFWAGSWILHYLSAKVSWTLANIYGPDCFIYPNLYQQPLIDHWLLQKYSKFGFNQWIKQPSQRSLLTAGFPNVLVLVLPKDKVETAMQTAKSTLISEWLNISKLVFSELEERYWMKSLSFDHKTWKGWLKSQWQTYWTAVPIGVDKKQEDQEGQLEKIALTSSEIYRENEEIKDSEIIEKDRSWVAIQNQAYGLNENTALFLEKELTFLQKAAKLRQDQQNKYPFNTNIGSWWAAIFDQTRLALTAVKNGRDWQIPTAFSTRSTISGLGSVVHPSDDWIEEGKTKALWKRQAGLFDGIEQLNATETVKRGLHLVLPKLLELEADKIQMSYPDLTAGMAGYLKNGTSEDLEHFEKTSKAVINEYLAEHNKIPDEITDKWGIPWADTNPTIKYHPRLLNAGWLVEDLEKESTAENRLKLQKLVKDYYPSNNPTDCYIIAAGDGDGMSEWLKGGKLKSYGHYTPENLNVEGDIAEAFNEFLTVPKRMGPSTHNALSRALLDFSNQLVPYLTEERYAGRLIYSGGDDVLAYTNLWEWDNWLWDIRQCFRGDKDPLGFNNDGTFNLEKSEFKNEGNYWQWNQENKPNHLAERPLFTMGQNATISFGIVIAHHSVPLAIALENLWEAEEEAKEHYINENNHKTYKDAVQVRVIYGNGNILKATSKFEVFEQWKKLLRINELEASLFEQAATLWTQHPIPIQEAIKPWTVAFCSRRETLNDDIRKSFQTALSKFIEDLWTNTSEEQLNQDVQSWFKLTAFVLRNRKIKLGGKA

SEQ ID NO: 126 - DNA, 3084 bp, Cyanothece sp.
gtgagtcatctgtatcatccgtattggcaagcaaaaatttgggcattactgcatgatccagccttaaaacccttatcggatcgatatggttttgcgagagaggggcaatggcagttattgcgatgtatgcaaggatgtaagtcccctaaagataacaaaaaggtgttaggagactgtgtattgcagggtaactggttaaaccatgtggggttatgtgatttagtcgcttcggccagcgatcgcagtaccatcggcagactcgatccacaatatagcgcagttacctatcaacagcaaaccggcttacagatccgtcatttattatcaggagaaccccaaaaccttaaagttaataataactggcaagaaaacttaattactaaacggaagaaactagaagcaaaagaagcagaatttttagataaaattagccagtgggaagatccaaaaaaagttttttgggcgttatggagatgttatgctgaagtcttagaaaaagaagaagctttaatacatttattaccagcagaaactcgtttaccggatggatcattgtggagtcatgtgagtatgacttctgcattagctggagggttagccgggtattataaacaagctgaaaattatcctattaaaaaccaaaaatttaatgattattctcgaccgtatttagttaattttaccttttctcctgtacaagaattgatcaaagcgagtcgcaaaatgcgagatttttgggcaggatcttggattttacattatctttctgctaaggtttcttatgcgatcgctaatgaatatggtcccgatactttactctatccttgtctgtatcaacagccattaattgataactggttattagaagaatattctgatttcaaggaatggatagaacctcataaacccgatcaattattaacggcaggtttccctaatgttattattatgattttacccaataatcataaatctcaacaggatctaaaagataatcctatttatgcagcgactcagttagcaaaacgtactttaaaagaagaatggaaaaagttaggagatcaaagtttagaatttttacaagatagtaaacagtggcaaaatattaacccaaatacttgggataaatggttaaagtgtcaatggcaaacttattatacagcctttcctattggtgatcctgagagtgacttaacttgttctttaagagtgggtaaaaatgaaacggaagagcaaaaaaaagacgcttttgaagcttggtgtcatcaacaaaatcagttaaccaacccgaaagaatctttatttgaaaccaatgaagagaaatttttaaaagctatctttaaactaaccgatatagaaacagaaaaagaaccaccaaaaacaaaatatagtaagcaacctaacttaaatgtaggatcatggtgggcttatgtttttgatcaattaagaaccagtttaaatgcagttaaaaatgctagaacttgggaacttcccacagcctttaccgttcgttctagcttatcaggaatcggttctgcagttcatcctattgtcaatgaagagaaacccgatcgcatttctgaaaaagaaattaacgagttttggtcagaaaaattcggtttatttgatggtactgaaaaactcaatgcaacggaaattgtcaagcgagtgttacataaattattacctgagatattgaactatgaagaacaagaaatcagcttatattatcctgatttaaccgccggagtcgccggttatttaaaaaatgcactattaaacaatcaacagtcagaaattgattattataaacgttcttgtcataagatttacaaagaaattcaaccgcttttagataatgataaccttagccaaagttggggtattccttggattaataataataaagaattgaaactgagtaataccattcatcatcctcgtttactcaatgcaggttggttactcgaagatgtagaaatatcccatgatagtaatatagagtatcgagaaaaattagaagaattaagtacaaaaagaacaactatacaacaagttatcaataaatattatcctagtaataatcctaccaattggtatattttagttgctggtgatggtgatagtatgagagactggttaagaggtagtaaattaaaaaattatggtgaatatttgcccgatgaattaagagaaaaaattattaatgatagtaatgatgaaattcctaaagaatataaagaacccttacaaaactttctcgaagttagaaaacgtatgggaccatcaacccatagtgctttaagtcgtgccttacttgacttttctaatcaattagttccttatttaaccgaacaaagatacgcaggaagattaatttatagtggtggcgatgatgttttagcttatacaaatttatgggaatgggacaactggttatgggatattcgtcaatgttttaagggtcaagaagatccctataatgagtttaaaaatgagggtgactattggcaatggaataaaccaaataaacccaaaaatatagcccaaagacctttatttacaatgggaaaatgtgctactattagctttggaattgtgattgctcatcactctattccgttagcgatcgctttagaaagtttatgggaagcagaagaagaagctaaagaacattacacacaaaaagataataaagacacttacaaagatgccgtacaagttcgagttttgtatggtaatggaaacaccttaaaatctacatcaaaatttgatatttttaaccagtggaaacaactgctaaaattagacttagaacccagtttatttgaacaagctgctaccatttgggaacaacatcctatcccagataaaagtgcaattgaaccctggacaaaagccttttgtagtcgtcgagatataggagaagaattacaacaagactatcaaaaaatattaaccagttttattcaaggattatggataacgacccctcaaaataacttagataaagaggttaagaactggctaaaactggcagcatttgtgaaacgaaatcgtaaaattagcttaaaccaggagtaa

SEQ ID NO: 127 - protein, 1027 aa, Cyanothece sp.
MSHLYHPYWQAKIWALLHDPALKPLSDRYGFAREGQWQLLRCMQGCKSPKDNKKVLGDCVLQGNWLNHVGLCDLVASASDRSTIGRLDPQYSAVTYQQQTGLQIRHLLSGEPQNLKVNNNWQENLITKRKKLEAKEAEFLDKISQWEDPKKVFWALWRCYAEVLEKEEALIHLLPAETRLPDGSLWSHVSMTSALAGGLAGYYKQAENYPIKNQKFNDYSRPYLVNFTFSPVQELIKASRKMRDFWAGSWILHYLSAKVSYAIANEYGPDTLLYPCLYQQPLIDNWLLEEYSDFKEWIEPHKPDQLLTAGFPNVIIMILPNNHKSQQDLKDNPIYAATQLAKRTLKEEWKKLGDQSLEFLQDSKQWQNINPNTWDKWLKCQWQTYYTAFPIGDPESDLTCSLRVGKNETEEQKKDAFEAWCHQQNQLTNPKESLFETNEEKFLKAIFKLTDIETEKEPPKTKYSKQPNLNVGSWWAYVFDQLRTSLNAVKNARTWELPTAFTVRSSLSGIGSAVHPIVNEEKPDRISEKEINEFWSEKFGLFDGTEKLNATEIVKRVLHKLLPEILNYEEQEISLYYPDLTAGVAGYLKNALLNNQQSEIDYYKRSCHKIYKEIQPLLDNDNLSQSWGIPWINNNKELKLSNTIHHPRLLNAGWLLEDVEISHDSNIEYREKLEELSTKRTTIQQVINKYYPSNNPTNWYILVAGDGDSMRDWLRGSKLKNYGEYLPDELREKIINDSNDEIPKEYKEPLQNFLEVRKRMGPSTHSALSRALLDFSNQLVPYLTEQRYAGRLIYSGGDDVLAYTNLWEWDNWLWDIRQCFKGQEDPYNEFKNEGDYWQWNKPNKPKNIAQRPLFTMGKCATISFGIVIAHHSIPLAIALESLWEAEEEAKEHYTQKDNKDTYKDAVQVRVLYGNGNTLKSTSKFDIFNQWKQLLKLDLEPSLFEQAATIWEQHPIPDKSAIEPWTKAFCSRRDIGEELQQDYQKILTSFIQGLWITTPQNNLDKEVKNWLKLAAFVKRNRKISLNQE

SEQ ID NO: 128 - DNA, 2826 bp, Synechococcus sp.
tcatcgaccgttcctccccaaagtgacggtgcggttgcgcagcacaaaggccgccagcttgaaccagtttttgatggccagatcccaggcccccggctgggcgggcaggctgtgctgccaaaagtgctgaataaactcgaccagcttggtctggaaacgatccgtctgctcgctttcgccgtggaagagatcccggcggctgcagaacaggcgggcccaagcaggcaccgcttccaggctgggggctgggtgctgctcccagagctgggcggcgtgttcaaatagggagctttgatcctgcttttggcccaacagcttccagtcaaaatccagcaggtctttccacttgtcgaaggtgtcgaacttgcaggtgctcaccagttggttgccgttggcaaacagtacccgcacctgggcgctgtctttggagctgccctgggcataggcctgctctttggcgccttgttctgcctcccagagattctccagggcaatggccaggggcaccgagtggtgggcaatcaccaccccaaagctaatgctggccagggatcccagagtaaaaagagggcgacggctgaggccagccggcaactgcgccttttgccactgccagtagtccccttcgttggcaaactcgcgccagtcgtcttcgccgccgcggaaacattggcggatgtcccagagccagccatcccactcccagaggttggtgtaggccaaaacgtcgtctccgccggcgtagataagcctgccggcatagcgctgctcggtgaggtagggcaccaactggccggaaaaatccaacagagcccggctgagggcgctgtgggtggccgggcccatgcgcttgcggctggctttaacaaactcgctgaaggcgtccttgacttgcttgagctcttcagagtcgaggacgcggccaatagcgtccctctggccatccgctaggcgctgcagcggctggggcaggtagtcgtagtagggcttcatcttccccccgctcagccactggcccatgtcgtcgccatcgccggcggccaccacgtaccaactggcggggttgatgctggggtagtagcggctgagggtggcttctatctcctggcggcagcgcttctgggttgcctcgtctgcttccaggtcctccaccagccagccggcgttgagcaggcgggggtggtagcgcaggttttgctggtcggcccacgggatcccccacttgccacgcatctcccggatcacctcccgcatgccggggtgaatggcctcaacggcgcggcaggcctgctcgaagtgctccagctcgcgtcgcccgtgggttttcaggtaaccggccacgccagcagtgagatctgggtaggaagcggcgacctcgtcttcgtcgagggtggggaagagctccggcaacaccttgtctagggcccgcttaaccgtttcggtggcgttgagctgctcgcggccatcgaaaagccctgcctggcgctgccaaagccgccggctctccccttcgctaatccagcgattcctgggggaagggtgaaccaccggccctaggccagagacggtgctgcgcggcccaaaggtcaccggcaactgccaatcgcgggcctgtttgcaggctgcctgcagccggcgcgtcgcctccactgccgctgcccaccaggagcctacgtttagccctggcttgtgctggcggcactgctgcctttcgggatcccagaagctgatccgcaggaacttcagctccggatcggcaaaaagctgccgctttcctttgagatggtaggtgcggttttgggcgctgacccagggatcccgctcaatggactcctgggacctgaggatggcggtgtctttgagcctttgctggggggatcccaggggcgctgccgcccagtagaactgccactggtgctccagccatcccccccaggtgggatcttctgggcgcaactgcaccagccagcggcgctccagttgcaggtgctccagcgctctttccgccaggtggcgccattcttctttgagggtctgctgggcaaactgcatggccgcctgcagccgctcttcgggcaacagcaagaggatcacgttggggaagccggcggtgagcagagtgttggcagaaggctgcgggatccactcggcaaagggggggtacttctccagcagccaagcgtcgatcaaaggctggccgtagaggctggggtagagcaggcagtcggggccgtatttctccgccaggcgccagcaaagccgcgccgagaggtagtgcaacagccaggatccggcccaaaagtcccgcatcttgcggctggctttgatcagctcctggatggggttgaaggtcaagctggccaaaaagggccgcgtgaacttgggctcgtcgtagccggccaaacagcccgccagagcggccacgacgctagtgtggctccacagggatccatcgggcagccgcgtttctgccggcaaaagcaggaggctttcatcgccaaactcccgcgccagcgcctggggaaaacagcgccagaaccaccagaacaccttctggatatcctcctgttcttgccaaatccagtcgggaactacccttgcttcctgcgccagcaagtactcggcgcgggagctggcctgccgcagggcgcggtgttcttcttcgggcagttgccaaaagcgcttgcgccccgaaaggagatggctcatctctaagcccggccccaggctctggctgcaatcagctacctggtagtcgatggcaaccggcaggtggccgatagcagcccgatcgctggcggaggcgaccagatccgcatctcccac

SEQ ID NO: 129 - protein, 941 aa, Synechococcus sp.
MGDADLVASASDRAAIGHLPVAIDYQVADCSQSLGPGLEMSHLLSGRKRFWQLPEEEHRALRQASSRAEYLLAQEARVVPDWIWQEQEDIQKVFWWFWRCFPQALAREFGDESLLLLPAETRLPDGSLWSHTSVVAALAGCLAGYDEPKFTRPFLASLTFNPIQELIKASRKMRDFWAGSWLLHYLSARLCWRLAEKYGPDCLLYPSLYGQPLIDAWLLEKYPPFAEWIPQPSANTLLTAGFPNVILLLLPEERLQAAMQFAQQTLKEEWRHLAERALEHLQLERRWLVQLRPEDPTWGGWLEHQWQFYWAAAPLGSPQQRLKDTAILRSQESIERDPWVSAQNRTYHLKGKRQLFADPELKFLRISFWDPERQQCRQHKPGLNVGSWWAAAVEATRRLQAACKQARDWQLPVTFGPRSTVSGLGPVVHPSPRNRWISEGESRRLWQRQAGLFDGREQLNATETVKRALDKVLPELFPTLDEDEVAASYPDLTAGVAGYLKTHGRRELEHFEQACRAVEAIHPGMREVIREMRGKWGIPWADQQNLRYHPRLLNAGWLVEDLEADEATQKRCRQEIEATLSRYYPSINPASWYVVAAGDGDDMGQWLSGGKMKPYYDYLPQPLQRLADGQRDAIGRVLDSEELKQVKDAFSEFVKASRKRMGPATHSALSRALLDFSGQLVPYLTEQRYAGRLIYAGGDDVLAYTNLWEWDGWLWDIRQCFRGGEDDWREFANEGDYWQWQKAQLPAGLSRRPLFTLGSLASISFGVVIAHHSVPLAIALENLWEAEQGAKEQAYAQGSSKDSAQVRVLFANGNQLVSTCKFDTFDKWKDLLDFDWKLLGQKQDQSSLFEHAAQLWEQHPAPSLEAVPAWARLFCSRRDLFHGESEQTDRFQTKLVEFIQHFWQHSLPAQPGAWDLAIKNWFKLAAFVLRNRTVTLGRNGR

SEQ ID NO: 130 - DNA, 3330 bp, Arthrospira maxima
atggacaactttctcggttctcttaatcattcctcactgtgcaatatcgtcttccttcgcaaactttgtgctttagttggtgatcgccatctctgtaacagcctggattgtttgaaaacctcggagggacaagcggcgctgttttggtgggaacaaaatcaacatcagcttgaagcgatcgccagttcctcagatcgggtcaatttggaaccaggaagctcaacagaacgacaaactaaagaacggatcattaaacatcccatcagcgctcaacagcaaaccattcaaactccagacaacagagaaatcgcctttccccaatgggttcaacaggaacaaaacccccaaaacgtatttaattggttgtggcgtatgatgccggaactaagacgacaacaggattcggacgctctactcgaccctcaacactacattttacccgactgtccgattcatagctatcgtgccacagtctcagcgatcgccggagcggtagactttgatgaacgggggattgtcactcaatacccttacttgctgctgtttaccttttccccgattcaggactttatcaaagcttcccgcaaatttctagacttttgggcagggtcatacttgctacactatctaagcgctcaactctgttggttcgtggctgaaacctacggtgtagatgcggtgattaccccctcgctttggggacaagaaatcatcgacgcactcttactcaaaacctatccaatttttagagaaagctttcaagaactcagccccgatggaacagaccccctgactcgttttaatgagcgtttgagtaccaccctagcaaccgcaggctttcccaatacgataaccatcttagttggaagctccgaaaccgcacaacaactcggagaaactttgtgtgaaaaattgcggtctgaatggagtgcgatcgcccaaaatattagagaaggaatccccgatcatcccatacccgaacttagacaaggaattcgcgatcgcaccatcgcatttctgcaaaacccccaaaatcataagcggattgagaagatcttagaagaattttcccagtcgggaggtcacgacgaacaaaaccgacatgatctcgaaaactggaagcggaaaagctgctgggaatggcggggattatggaatgctcaaattgaccaaacttggcaaccctactggacggctgttccgttgggtgatccgaatacttctctaatgattgagaaaaatgatgacgatcaattgagcgaagactggatcaaaaaacaagaaaaagtggctcaaactcgcgtgatcaatccccctcccacaacggcggaaaaaatgctctacacaaccctcaataatgggacttggtgggggtcaattcaatctcgatgcggtcaagccattcaagccattaaaaatactagaacttgggcaattcccatttctccgggtgttcgttctacattatcgggacaactgagcgccctacatcctcaatttcgatattctggaaacttccgggaaggatacggtttacctattgaatcaatgcgattattttggcgattaatagcagaagtttatccaggattatttgacggctcggaaatgctgaacgctctagaattaacgaagcgcatggcttgggtttatggtggtgtgggtgagtctttaggaattgattttagcaatttagaaaatgaaaaaatagactatagccaattaattcgctttcccaatctcagttctattgcttcagcccgatttgcttaccaagatttgcaacaagatcaaaatcacggtaaactcagtcaatattggcagaaattacaaattaatatcaaacaacaatttgggaaaaccagtcaagaatatcaggattttctggctcaaactcggggtcgtcctttccacatccctaaaaccgatatttgtattaatcgccaaaatttaccggggcgatactataacggcgtgatgttttctagcaaatggcttgccgaagatatgggattagaaaaagaacagagacccgagttgcgaaagattgtagacctaactcactccgaatgtggctttggcgacagtagcccaacagattggtgggtgatgatcttaggagatggggatggtatggggcaatatgtttccggtaaaaaacttcatccttaccaagaatatttaaccgaaactcatcccgaaactttcatcgatcgcgatcgctatcccgacctagatgaaaaccagtatgagcagaaaaaacggcagttcattaaagcctttagagatgataaacattccctgctgaaaacccgtaagcgcatgggacccgccactcatgttggtctaaaccgcgccctgctagacttctctaaccgtttagttccctttattaccgaaaagcggttttgtggtcgcgtggtctacagtggcggagatgatgtgatgacggtactccctttagaagatttacccgattatctgctctctctgagagccgcttggtgtgggggcgacgacccctatcaaccccaagcgggcgatccagacttgaaatttcaatcccaaggcggctactggcgacccacttcggatacaaatgattttcaaggcttaccagaccgatcgctgtttacgatgggattcggggcaacgatgagtctgggtatcgtgatcgtcgataaaagtgttcccctcccagtcgccctggaagccctttgggaagcagaatccgaccgggctaaagaattatccggtggtctactgatgtccatcgatctgttgcggggactgacggaatggcgatcgctatctttgatgcgatttgtcctgtctgaaattttccgtttatcgagtgttcccaacaaaaacggcctatgttttcgagttctctacagttcaggaaacaccctagaagctctgatcaaaggagaattatacgccggttggcgagattggatcaccactgaacatcatcaagccttgagttctctactctatcgcctcgccgaagaactcccccgccatgcggatttgaccccatcttcttacttaattgctcaagccgccagagcgatcgccttacgccgagacgacaaagacttggttcaagaaaatatcgacaaactgttgatctggctcagatattgggaagattgggcgcgatcagtccatgttcaatggttaatcgaccgggagaaaaaccccgatactcccaaaccaattggaattgaccttaaggacttaagtaatattctgcgtttttcggcgttttggctcgataaaatgcagcaacgccaacaatggcacagacaggatcaggaggcttag

SEQ ID NO: 131 - protein, 1109 aa, Arthrospira maxima
MDNFLGSLNHSSLCNIVFLRKLCALVGDRHLCNSLDCLKTSEGQAALFWWEQNQHQLEAIASSSDRVNLEPGSSTERQTKERIIKHPISAQQQTIQTPDNREIAFPQWVQQEQNPQNVFNWLWRMMPELRRQQDSDALLDPQHYILPDCPIHSYRATVSAIAGAVDFDERGIVTQYPYLLLFTFSPIQDFIKASRKFLDFWAGSYLLHYLSAQLCWFVAETYGVDAVITPSLWGQEIIDALLLKTYPIFRESFQELSPDGTDPLTRFNERLSTTLATAGFPNTITILVGSSETAQQLGETLCEKLRSEWSAIAQNIREGIPDHPIPELRQGIRDRTIAFLQNPQNHKRIEKILEEFSQSGGHDEQNRHDLENWKRKSCWEWRGLWNAQIDQTWQPYWTAVPLGDPNTSLMIEKNDDDQLSEDWIKKQEKVAQTRVINPPPTTAEKMLYTTLNNGTWWGSIQSRCGQAIQAIKNTRTWAIPISPGVRSTLSGQLSALHPQFRYSGNFREGYGLPIESMRLFWRLIAEVYPGLFDGSEMLNALELTKRMAWVYGGVGESLGIDFSNLENEKIDYSQLIRFPNLSSIASARFAYQDLQQDQNHGKLSQYWQKLQINIKQQFGKTSQEYQDFLAQTRGRPFHIPKTDICINRQNLPGRYYNGVMFSSKWLAEDMGLEKEQRPELRKIVDLTHSECGFGDSSPTDWWVMILGDGDGMGQYVSGKKLHPYQEYLTETHPETFIDRDRYPDLDENQYEQKKRQFIKAFRDDKHSLLKTRKRMGPATHVGLNRALLDFSNRLVPFITEKRFCGRVVYSGGDDVMTVLPLEDLPDYLLSLRAAWCGGDDPYQPQAGDPDLKFQSQGGYWRPTSDTNDFQGLPDRSLFTMGFGATMSLGIVIVDKSVPLPVALEALWEAESDRAKELSGGLLMSIDLLRGLTEWRSLSLMRFVLSEIFRLSSVPNKNGLCFRVLYSSGNTLEALIKGELYAGWRDWITTEHHQALSSLLYRLAEELPRHADLTPSSYLIAQAARAIALRRDDKDLVQENIDKLLIWLRYWEDWARSVHVQWLIDREKNPDTPKPIGIDLKDLSNILRFSAFWLDKMQQRQQWHRQDQEA

SEQ ID NO: 132 - DNA, 2934 bp, Halorhodospira halophila
atgacggaggcaaccctcatggacattgatctggcccggaacaagctgctcgcccgactgcacgacccggcggagaaggcgctggtcctgctgcgcgatcccgccggccacgaggggggcaccgtgcgcaccctcatcgaggagatcctcggcgaggtgccgcaggcggcctgggcgcccgtgcgcaaggccgaccgctgggcctcggcggcggaccggccgcaattcccccgtgagcgcgacggcgatcgcttcgcgcgctggagccaggtgcgcttcgccgagcagccggtgctgcgccatccgctcaccggcgagaagatcgatctcggcgagcacggcaagctgcgggagatcgagctcgacacgctcaaggccggcagcctcgagcatttccggcacctgatccatcgtgacgaggcggggagcgtcgattcctggcggaccctgctcgcgctgtggcgcttcggccccgagccggcaacgagcggcgatgcgaccgggctcggcgagctgtggcgctatctgccggcggatacccgcatcccggaccacaccatctggcagcacctggacctgagctccgcgctcaccggcgccttcgcgggcgatggccagggccgctgcgccctgctcaacgtcaccctcggcccggtgcaggagctgatcgccgccgcccggacgacctcggacctatgggccggctcgcacctgctcgcccggctcgcctgggaggcgatgcgcgtcgtctgcgagcgcctcggccccgacgccgtgctcttcccgcagctgcgcggcgtcccgcaggtcgacctctggctcctcgagcaggggctggcgccggagctcttcgcgaaggagccctggaacgagcgcaccgtcaccgacgccaacccgctgttcagcgccgccctgcccaaccgcttcctcgccgtggtcccggcggatcaggcggaggcgatcggccgcgccatcgaggcgcacctgcacgagtgggtcgccgagaccgccgagggcgtggtcagcgatctgctcagggccgtcaacctgcacaccgatccgacaacacccgcctatcagcaggcacgggagcagctggccggattccctgaggtctactggtcggccgtgggctgggacgagatcgccacggacgccaacggcgagcccgaggcggaccgcctcgccgaggccctgcgccccttctatgagccgcaggccgaggcccccggcttcctcagctccgaggcctggcgcgtactacagcggcccatcgaggtcatcgatccggaagcggggacgccggcgaccttctaccggcccaatcccggcgtgctctaccccgcgctctacgagctcagcgagcgagtgatgggcggcgtcaaggcgacccgccccttcgccgcgcagcacgagggcggctatcgctgctcgctgaccggcgaggtggagtggctgacccacgatcgcagccacctcgacctgccgccgggccagcgggaagggcacgacaccctctggagcctcgttgccaagcgccacccgagctgggcgcgcaagggtgagcacctcggggcgctggccgccctcaagcggctctggccgcagcgcttctgccgcgaactcgccgggaccctcgggcaggagcagacgccgcgcttcgtcgtctccacgcacaccatggcgctggccacctccctggcccgcgctgccgaggagccgaatcccgccggcgggctcagcgccgagcaggccgaggcgatccgcaacgccgatcgggttgcgctaccgcggcggctggcgcagcggctacaccacctcgagcacggtgagctcctcgcccggttgcccggctgggtcgagcagcagcgcgaatccgacgacggcgatgagaccgccgcccggcaggcgatccgcaaggtcaccggcaccgaggccgaggcctactacgccctgctgctcatggacggcgaccgcatgggggcctggctctccggcggcgacgggacgaccatcccctaccgggcggccttccaccccgacctggcggacgcagtggacacacgcttcggcgaccatacggtcctgcaggcgtacctcgacacgccgcgggcggtctcaccggcccggcacctggccatctccggggcgctgaacgacttctccaccaccctcgcccgcagggtggtcgaggagtgtcaccacggccgcgtcctctatgccggcggcgacgacctcatggccatgctgcccactggcgatctgctcagcgccatgcgcgagctgcgcgacgcttactcgggcacggctaccagcggtgaggccgaggaagaggacgcctggtgccgcaacggcttcatctatcggcaggaccggctgtacctgaccatggggtcgcaggccaccgcctcgatgggggcggtgatcgcccaccataagacccctctgaccgcggccctcgctgaactgcgccaggccgagcagcgggccaagaacgagggcgggcgcgacgccttcgccctgtccgttctcaagcgcagcggcggcgccctgcgccacgtcggccgctgggcaccagcagcgggtatcgacgagatgagcgccctgcgcgacttcgccgaggcgctccatgccaaccccgaggcctcccggcgcgccgcctacaacgtcgcgggctggctcgccgatctccccgagcccgacaccctccccccggaggacggcgtcgccggctacctcgaggcggtgctgcactaccaattctgccgccagggcctcgagcagcaggggcagcccatccacgcgcggcggctcggatcgctcgccagcgtctcgccaaccggcgacgagctgagcagcgccgccaagatccgcgaccgtctcagccacctcgtcggcgtggccgagttcctcgcccgcgagacccggaggtag

SEQ ID NO: 133 - protein, 977 aa, Halorhodospira halophila
MTEATLMDIDLARNKLLARLHDPAEKALVLLRDPAGHEGGTVRTLIEEILGEVPQAAWAPVRKADRWASAADRPQFPRERDGDRFARWSQVRFAEQPVLRHPLTGEKIDLGEHGKLREIELDTLKAGSLEHFRHLIHRDEAGSVDSWRTLLALWRFGPEPATSGDATGLGELWRYLPADTRIPDHTIWQHLDLSSALTGAFAGDGQGRCALLNVTLGPVQELIAAARTTSDLWAGSHLLARLAWEAMRVVCERLGPDAVLFPQLRGVPQVDLWLLEQGLAPELFAKEPWNERTVTDANPLFSAALPNRFLAVVPADQAEAIGRAIEAHLHEWVAETAEGVVSDLLRAVNLHTDPTTPAYQQAREQLAGFPEVYWSAVGWDEIATDANGEPEADRLAEALRPFYEPQAEAPGFLSSEAWRVLQRPIEVIDPEAGTPATFYRPNPGVLYPALYELSERVMGGVKATRPFAAQHEGGYRCSLTGEVEWLTHDRSHLDLPPGQREGHDTLWSLVAKRHPSWARKGEHLGALAALKRLWPQRFCRELAGTLGQEQTPRFVVSTHTMALATSLARAAEEPNPAGGLSAEQAEAIRNADRVALPRRLAQRLHHLEHGELLARLPGWVEQQRESDDGDETAARQAIRKVTGTEAEAYYALLLMDGDRMGAWLSGGDGTTIPYRAAFHPDLADAVDTRFGDHTVLQAYLDTPRAVSPARHLAISGALNDFSTTLARRVVEECHHGRVLYAGGDDLMAMLPTGDLLSAMRELRDAYSGTATSGEAEEEDAWCRNGFIYRQDRLYLTMGSQATASMGAVIAHHKTPLTAALAELRQAEQRAKNEGGRDAFALSVLKRSGGALRHVGRWAPAAGIDEMSALRDFAEALHANPEASRRAAYNVAGWLADLPEPDTLPPEDGVAGYLEAVLHYQFCRQGLEQQGQPIHARRLGSLASVSPTGDELSSAAKIRDRLSHLVGVAEFLARETRR

SEQ ID NO: 134 - DNA, 2721 bp, Thermoanaerobacter italicus
ttatttctcacctcctcgattcaaaaaagctaatatcgttaagaggctaataaaattgtcgtattttacctctttatacagagaatatagtaaaatgtataaatctctttcaactttttctttttcatctttacttaagttctcattcaatgaacgtttaatatttcttttgagctcactaataaaaatgccttgtggaagagaatctacatctagcctttccaaagctgcttttaattttccaacaaaagaaatacttaatttgtcttctttaaaaaaggaatttatatcttttaataaacctattgttccttctttatttcttgcatcatcataattccacttggctctggcaatgtaattctcaccagaatgcaaaataagttttattgcaaaggcatcctttccttctactttttttgcatattcttcctctacctcatctacagaagctataacattttttaaatcttctttataatgagctataactacccccattgacgccgtggctttgtttcccatcatcacatcaatttcctcttttcgttccacaaatccggcatctattgtaaaatctggaattatctcattattaacaattaagtgcccactgaaagccgccctaagttttaccataacatctaataaataattaagatttactattgcaaatacatcatctccgccagaatatattacttttcctgctcttgtctcttccactatttcttttacatatttcaaagaatagttcttaagtgcctcactaattaaagagtgaacagctggtgtcattagtcgctttttatccttgattttttctttaaaatcttctggtaaaaaaccctgcaatttactgtggtacatttctaacatatagggtgccaattctcctgctaaccatttccccatgttatcgccatcaagctttataacggcataatatttctttttattcagtcttatgtctttaattcttttatcaatactctttaataattctttaagtttgcctaatctttttgaattaaaatcataagttttaaaataattttcattgagattttcctcatacaacaattcataatcaaagttatcaccgcaccactttttgaatacttctttgtatctttttatatttgtttttaggtcattatctgaattgttaattatatctagtaatgctatctctgcagtagagggaaaactttcttctatgttgtttttcccaaacatatctttaaaatatatttctgccgccctttttgtcaggcatctgctgcacaacccttctccttgtgctaaatacttataagtaatacttttatcatcactttttttgattattgcattttgttctctaagaagtttaatcttataactttctttccctttttctatcttttcatcttcttctctcgtacacctgtagataataacattgtgctcaccgcatatagaacattttcgccctatttcttcatattgattgaagtttcttatgccttttcttgtccccatcattttctccataaaagaataaagtaacccataaatattaccaatgttaggcccgtattcacctttatctttaatatatctcaataaatcctttatctcttccacctcatcactgttaaaataatcctttatcttatccaattggatttcccaatcaggcctgtttacatccccattttctaaaggcaacgccacccaatacacatctggaaagtttgataattggcgtaaaagcaattttttttgctcatcattgctttttacaagatgactaaaaacatattccccgatttttatatattcatcttttactgtttttttaagatttagtaacctaatttcttctacattttttgttggtaaaattgcaaaaaatctgttgggaagagtaggagttttaaggtctttagtcgtagttgcactgttattaaatagctttgctatccaaaaatcgcacaaaggctgttctttaagttcagggaatattatagaatctggtccataagcttctataactttttctattgccacccacgttaaataagacaaaatataacttccccaatacaagtcttgtgtcttccttgcctgcacaatatattcttgaacaggacctattgtaaaaataaatagtgtcatattgtttaaattcaattcattataaaaatatgcattcaccgcagatgccaatttcaaatgctcaaatattgtgtgattaggaaatcgagtatcagcaggagctaaatcccaatattttctatattcacttggcgtatgtttctttaaaagctctttcaaataacgccataaatacacaaattttttataactatctttaaagtctagttttgataactcatctactgcttcatctacagcctttttaaacacttctttttctataacaaaattattatatcgattagctgcaagaggatgaacaaactcaggttgttcttcaaaaacaacttgtaaatttttatttttactggcatctttaggtatataatatctttccataaatgaagctaaaacatctgaagcaatagttttgtggtaaggaatatctatttttttagatatttccttagctcttttctcatggttttcacctgttaacaaaataaatggcttatctggagaatcatgaaaatatgctttcaatttattttcaaataactcttctttcttactcat

SEQ ID NO: 135 - protein, 906 aa, Thermoanaerobacter italicus
MSKKEELFENKLKAYFHDSPDKPFILLTGENHEKRAKEISKKIDIPYHKTIASDVLASFMERYYIPKDASKNKNLQVVFEEQPEFVHPLAANRYNNFVIEKEVFKKAVDEAVDELSKLDFKDSYKKFVYLWRYLKELLKKHTPSEYRKYWDLAPADTRFPNHTIFEHLKLASAVNAYFYNELNLNNMTLFIFTIGPVQEYIVQARKTQDLYWGSYILSYLTWVAIEKVIEAYGPDSIIFPELKEQPLCDFWIAKLFNNSATTTKDLKTPTLPNRFFAILPTKNVEEIRLLNLKKTVKDEYIKIGEYVFSHLVKSNDEQKKLLLRQLSNFPDVYWVALPLENGDVNRPDWEIQLDKIKDYFNSDEVEEIKDLLRYIKDKGEYGPNIGNIYGLLYSFMEKMMGTRKGIRNFNQYEEIGRKCSICGEHNVIIYRCTREEDEKIEKGKESYKIKLLREQNAIIKKSDDKSITYKYLAQGEGLCSRCLTKRAAEIYFKDMFGKNNIEESFPSTAEIALLDIINNSDNDLKTNIKRYKEVFKKWCGDNFDYELLYEENLNENYFKTYDFNSKRLGKLKELLKSIDKRIKDIRLNKKKYYAVIKLDGDNMGKWLAGELAPYMLEMYHSKLQGFLPEDFKEKIKDKKRLMTPAVHSLISEALKNYSLKYVKEIVEETRAGKVIYSGGDDVFAIVNLNYLLDVMVKLRAAFSGHLIVNNEIIPDFTIDAGFVERKEEIDVMMGNKATASMGVVIAHYKEDLKNVIASVDEVEEEYAKKVEGKDAFAIKLILHSGENYIARAKWNYDDARNKEGTIGLLKDINSFFKEDKLSISFVGKLKAALERLDVDSLPQGIFISELKRNIKRSLNENLSKDEKEKVERDLYILLYSLYKEVKYDNFISLLTILAFLNRGGEK

SEQ ID NO: 136 - DNA, 2721 bp, Thermoanaerobacter mathranii
atgagtaagaaagaagagttatttgaaaataaattgaaagcatattttcatgattctccagataagccatttattttgttaacaggtgaaaaccatgagaaaagagctaaggaaatatctaaaaaaatagatattccttaccacaaaactattgcttcagatgttttagcttcatctatggaaagatattatatacctaaagatgccagtaaaaataaaaatttacaagttgtttttgaagaacaacctgagtttgttcatcctcttgcagctaatcgatataataattttgttatagaaaaagaagtgtttaaaaaggctgtagatgaagcagtagatgagttatcaaaactagactttaaagatagttataaaaaatttgtgtatttatggcgttatttgaaagagcttttaaaaaaacatacgccaagtgaatatagaaaatattgggatttagctcctgctgatactcgatttcctaatcacacaatatttcagcatttaaaattggcatctgcggtgaatgcatatttttataatgaattgaatttaaacaatatgacactatttatttttacaataggtcctgttcaagaatatatcgtgcaggcaaggaagacacaagacttgtattggggaagttatattttgtcttatttaacgtgggtggcaatagaaaaagttatagaagcttatggaccagattctataatattccctgaacttaaagaacagcctttgtgcgatttttggatagcaaagctatttaataacagtgcaactacgactaaagaccttaaaactcctactcttcccaacagattttttgcaattttaccaacaaaaaatgtagaagaaattaggttactaaatcttaaaaaaacagtaaaagatgaatatataaaaatcggggaatatgtttttagtcatcttgtaaaaagcaatgatgagcaaaaaaaattgcttttacgccaattatcaaactttccagatgtgtattgggtggcgttgcctttagaaaatggggatgtaaacaggcctgattgggaaatccaattggataagataaaggattattttaacagtgatgaggtggaagagataaaggatttattgagatatattaaagataaaggtgaatacgggcctaacattggtaatatttatgggttactttattcttttatggagaaaatgatggggacaagaaaaggcataagaaacttcaatcaatatgaagaaatagggcgaaaatgttctatatgcggtgagcacaatgttattatctacaggtgtacgagagaagaagatgaaaagatagaaaaagggaaagaaagttataagattaaacttcttagagaacaaaatgcaataatcaaaaaaagtgatgataaaagtattacttataagtatttagcacaaggagaagggttgtgcagcagatgcctgacaaaaagggcggcagaaatatattttaaagatatgtttgggaaaaacaacatagaagaaagttttccctctactgcagagatagcattactagatataattaacaattcagataatgacctaaaaacaaatataaaaagatacaaagaagtattcaaaaagtggtgcggtgataactttgattatgaattgttgtatgaggaaaatctcaatgaaaattattttaaaacttatgattttaaatcaaaaagattaggcgaacttaaagaattattaaagagtattgataaaagaattaaagacataagactgaataaaaagaaatattatgccgttataaagcttgatggcgataacatggggaaatggttagcaggagaattggcaccctatatgttagaaatgtaccacagtaaattgcagggttttttaccagaagattttaaagaaaaaatcaaggataaaaagcgactaatgacaccagctgttcactctttaattagtgaggcacttaagaactattctttgaaatatgtaaaagaaatagtggaagagacaagagcaggaaaagtaatatattctggcggagatgatgtatttgcaatagtaaatcttaattatttattagatgttatggtaaaacttagggcggctttcagtgggcacttaattgttaataataagataattccagattttacaatagatgccggatttgtggaacgaaaagaggaaattgatgtgatgatgggaaacaaagccacggcgtcaatgggggtagttatagctcattataaagaagatttaaaaaatgttatagcttctgtagatgaggtagaggaagaatatgcaaaaaaagtagaaggaaaggatgcctttgcaataaaacttattttgcattctggtgagaattacattgccagagccaagtggaattatgatgatgcaagaaataaagaaggaacaataggtttattaaaagatataaattccttttttaaagaagacaaattaagtatttcttttgttggaaaattaaaagcagctttggaaaggctagatgtagattctcttccacaaggcatttttattagtgagctcaaaagaaatattaaacgttcattgaatgagaacttaagtaaagatgaaaaagaaaaagttgaaagagatttatacattttactatattctctgtataaagaggtaaaatacgacaattttattagcctcttaacgatattagcttttttgaatcgaggaggtgagaaataa

SEQ ID NO: 137 - protein, 906 aa, Thermoanaerobacter mathranii
MSKKEELFENKLKAYFHDSPDKPFILLTGENHEKRAKEISKKIDIPYHKTIASDVLASSMERYYIPKDASKNKNLQVVFEEQPEFVHPLAANRYNNFVIEKEVFKKAVDEAVDELSKLDFKDSYKKFVYLWRYLKELLKKHTPSEYRKYWDLAPADTRFPNHTIFQHLKLASAVNAYFYNELNLNNMTLFIFTIGPVQEYIVQARKTQDLYWGSYILSYLTWVAIEKVIEAYGPDSIIFPELKEQPLCDFWIAKLFNNSATTTKDLKTPTLPNRFFAILPTKNVEEIRLLNLKKTVKDEYIKIGEYVFSHLVKSNDEQKKLLLRQLSNFPDVYWVALPLENGDVNRPDWEIQLDKIKDYFNSDEVEEIKDLLRYIKDKGEYGPNIGNIYGLLYSFMEKMMGTRKGIRNFNQYEEIGRKCSICGEHNVIIYRCTREEDEKIEKGKESYKIKLLREQNAIIKKSDDKSITYKYLAQGEGLCSRCLTKRAAEIYFKDMFGKNNIEESFPSTAEIALLDIINNSDNDLKTNIKRYKEVFKKWCGDNFDYELLYEENLNENYFKTYDFKSKRLGELKELLKSIDKRIKDIRLNKKKYYAVIKLDGDNMGKWLAGELAPYMLEMYHSKLQGFLPEDFKEKIKDKKRLMTPAVHSLISEALKNYSLKYVKEIVEETRAGKVIYSGGDDVFAIVNLNYLLDVMVKLRAAFSGHLIVNNKIIPDFTIDAGFVERKEEIDVMMGNKATASMGVVIAHYKEDLKNVIASVDEVEEEYAKKVEGKDAFAIKLILHSGENYIARAKWNYDDARNKEGTIGLLKDINSFFKEDKLSISFVGKLKAALERLDVDSLPQGIFISELKRNIKRSLNENLSKDEKEKVERDLYILLYSLYKEVKYDNFISLLTILAFLNRGGEK

SEQ ID NO: 138 - DNA, 2730 bp, Thermoanaerobacter tengcongensis
ttattcattacaggaatgctccattgcaattgaccttgctataatcaacatattagcaaaatctatcactctatctggcgtttctttaactatctcatcaaactttgggagcaatatctcactagcatatttttctaaaatatctctgtttccactctgacgaagaaatattctctttaattcatttctcaaaatcccaataatttgttctttattttcgtcatcatacaatctgtctactacctcaaaaaattgatagggaaaagtggatgaaaattctcctttcttgaaatgctctatgagttctctcaaaaaatccatcaacgcccatttgcccccgcattcttttagtgctccacttccttttataaacttaaggcaaaaagcatttctattatactgtctttcgtcttttgctttcttctgagccaattgaacctctttcaaggcaaggtaaagaggatatttgtgatgaactattacaatgcctgcactcatggaggcttcagaacttaaaacttctttaaaagcgttctgcaattcataagcacattccaacacctcttctacaggaagtaatgctagaacgtcatctcctcctgcataaaccaatttcccgtaatgtgtttcttctacaattcttcgcacttcttgaagagcaaacgtggaaattttcctactcaaggtctggtgaagagaaggagtagtagggtgtttcttacaaagtatcgaagataggttatcttttgcatgttgttttatatgttctcccactttggggtgtaaagtttccattataggtggattattctctccttttaaccacttccccatgtggtccccatccatttgaagaatagcataatatctggaagggttgaccctgtgtttttctaaaagctttgttattttctgagacatcttctgaaattcctctactttgaagttctctgtatgctcacttttaatatattcttctctataactctccctcatcaaccactgtccatctatttcaaaaagttggttatcttttaatttcggaacagaaacagtattgggaagcaaaagcttctgtttaaattctccaaataattccttgaactctgcaataaactctttgttgtcagcaattctccttttttctccaatagttgccatttcagaagttgagggaaatttcatttcttcggaaagatttagctcttccttcattacctttgggaataatcgctttgcaagacacactccacagagttgctctttttcttttaccaagcctttttccttactcctcaatttttcccaatctaatggcaaaacttcaaactctccacataaactgcacttacgccctttttgttctaactgttcaaattcccttatgctcttcctcgctccaagcaatttttcagttagctcaagaagtaatgaataggctatgctaaaatctctgtattcctcatctttttctttatttttactccatatcttaggaacagattctataaactcacttatcgttttgtaaagctctgtctctcctattatttctttgtaatcatccaaaacctcttttggagactctttctcttcaaaccatggcataaccgcccagtaaacctggaaataatttaatagctgattttcaatctgcaattgaattttctctaaatccccctctagatttaaaatactttctaatcttttcactgtcttttttgctaggctctttagttgttctttaaagtttttctcgcactcttcgcccagttttaaagcttcaccttcattaattggcgcaattgcaagaaatctgttgggcatattggcaatagtcaacttttcttccaaacccttagaccttggaatgttattccactctttaaaccattcatcaaattccttttgtgataaatgagtaagcgaattaccaaatacctccgaactaagccataaatctacaagaggttgacctaaaagatttgggtacacaatcacatctgccccataacgttcaactacaaacttcatgattttccatataaagtaagaaagcatataacttccagcccataaatcagaagtttttctcgccgtagcaataaagctctgaacagggccaattgtaaagagcaaaaatgctggtttgggaagtgctgaaaccagagtagaagtttggacaaggtgatcatagatggagtgattgggcgcccttgtatctgcaggatggattctcatccagtgaaaaatttcttggtagaatctccatagaaataaaagcaagattttggctttttcttttttttcttcttcctttatcctagaaaggttataattctttgcaagcttctctactaattctaaaaaacgcttattctcagtttcataatctgtttctgccagtatatcgtaatatatttttttattaaacatgtcaaaaaatatcacatcttctcctcttattttaacagccactgggggaagtattctatttacaggataagcttgtgtatctgctttttcaataagtttctcttcttcctctgttaaatcttctccaagaagtggttcaattactttagatttaattaaaatctcatggcatcgacctttttcctgaagctggaacttttttatacattcttcattgtccatagaaattatccaatgcttatgaggagggtcatgaagaaaagctttaagtttcagaagccatactttttccat

SEQ ID NO: 139 - protein, 909 aa, Thermoanaerobacter tengcongensis
MEKVWLLKLKAFLHDPPHKHWIISMDNEECIKKFQLQEKGRCHEILIKSKVIEPLLGEDLTEEEEKLIEKADTQAYPVNRILPPVAVKIRGEDVIFFDMFNKKIYYDILAETDYETENKRFLELVEKLAKNYNLSRIKEEEKKEKAKILLLFLWRFYQEIFHWMRIHPADTRAPNHSIYDHLVQTSTLVSALPKPAFLLFTIGPVQSFIATARKTSDLWAGSYMLSYFIWKIMKFVVERYGADVIVYPNLLGQPLVDLWLSSEVFGNSLTHLSQKEFDEWFKEWNNIPRSKGLEEKLTIANMPNRFLAIAPINEGEALKLGEECEKNFKEQLKSLAKKTVKRLESILNLEGDLEKIQLQIENQLLNYFQVYWAVMPWFEEKESPKEVLDDYKEIIGETELYKTISEFIESVPKIWSKNKEKDEEYRDFSIAYSLLLELTEKLLGARKSIREFEQLEQKGRKCSLCGEFEVLPLDWEKLRSKEKGLVKEKEQLCGVCLAKRLFPKVMKEELNLSEEMKFPSTSEMATIGEKRRIADNKEFIAEFKELFGEFKQKLLLPNTVSVPKLKDNQLFEIDGQWLMRESYREEYIKSEHTENFKVEEFQKMSQKITKLLEKHRVNPSRYYAILQMDGDHMGKWLKGENNPPIMETLHPKVGEHIKQHAKDNLSSILCKKHPTTPSLHQTLSRKISTFALQEVRRIVEETHYGKLVYAGGDDVLALLPVEEVLECAYELQNAFKEVLSSEASMSAGIVIVHHKYPLYLALKEVQLAQKKAKDERQYNRNAFCLKFIKGSGALKECGGKWALMDFLRELIEHFKKGEFSSTFPYQFFEVVDRLYDDENKEQIIGILRNELKRIFLRQSGNRDILEKYASEILLPKFDEIVKETPDRVIDFANMLIIARSIAMEHSCNE

SEQ ID NO: 140 - DNA, 2724 bp, Carboxydibrachium pacificum
tcatatcctcgcctccattgcaattgaccttgctataatcaacatattagcaaaatctatcactctatctggcgtttctttaactatctcatcaaactttgggagcaatatctcactagcatatttttctaaaatatctctgtttccactctgacgaagaaatattctctttaattcatttctcaaaatcccaataacttgttctttattttcgtcatcatacaatctgtctactacctcaaaaaattgatagggaaaagtggatgaaaattctcctttcttgaaatgctctatgagtcctctcaaaaaatccatcaacgcccatttgcccccgcattcttttagtgctccacttccttttataaacttaaggcaaaaagcatttctattatactgtctttcgtcttttgctttcttctgagccaattgaacctctttcaaggcaaggtaaagaggatatttgtgatgaactattacaatgcctgcactcatggaggcttcagaacttaaaacttctttaaaagcgttctgcaattcataagcacattccaacacctcttctacaggaagtaatgctagaacgtcatctcctcctgcataaaccaatttcccgtaatgtgtttcttctacaattctttgcacttcttgaagagcaaacgtggaaattttcctactcaaggtctggtgaagagaaggagtagtagggtgtttcttacaaagtatagaagataggttatcttttgcatgttgctttatatgttctcccactttggggtgtaaagtttccattataggtggattattctctccttttaaccacttccccatgtggtccccatccatttgaagaatagcataatatctggaagggttgaccctgtgtttttctaaaagctttgttattttctgagacatcttctgaaattcctctactttgaagttttctgtatgctcacttttaatgtattcttctctataactctccctcatcaaccactgtccatctatttcaaaaagttggttatcttttaatttcggaacagaaacagtattgggaagcaaaagcttctgtttaaattctccaaataatttcttgaactctgcaataaactctttgttgtcagcaattctccttttttctccaatagttgccatttcagaagttgagggaaatttcatttcttcggaaaggcttagctcttccttcattaccttagggaataatcgctttgcaagacacactccacagagttgctctttttcttttaccaagcctttttccttactcctcaatttttcccaatctaatggcaaaacttcaaattctccacataaactgcacttacgccctttttgttctaagtgttcaaattccctcatgctcttcctcgctccaagcaatttttcagttagctcaagaagtaatgaataggctatgctaaaatctctgtattcctcatctttttctttatttttactccatatcttaggaacagattctataaactcacttatcgttttgtaaagctctgtctctcctattatttctttgtaatcatccaaaacttcttttggagactctttcttttcaaaccatggcataaccacccagtaaacctggaaataatttaatagctgattttcaatctgcaattgaattttctctaaatccccctctagatttaaaatactttctaatcttttcactgtcttttttgctaggctctttagttgttctttaaagtttttctcgcacttttcgcccagttttaaagcttcaccttcattaattggcacaattgcaagaaatctgttgggcatattggcaatactcaacttttcttccaaacccttagaccttggaatgttattccactctttaaaccattcatcaaattccttttgtgataaatgagtaagcaaattaccaaatacctccgaactaagccataaatctacaagaggttgacctaaaagatttgggtacacaatcacatctgccccataacgttcaactacaaacttcatgattttccatataaagtaagaaagcatataacttccagcccataaatcagaagtttttctcgccgtagcaataaagctctgaacagggccaattgtaaagagcaaaaatgctggtttgggaagtgctgaaaccagagtagaagtttggacaaggtgatcatagatggagtgattgggcgcccttgtatctgcaggatggattctcatccagtgaaaaatttcttggtagaatctccatagaaataaaagcaagattttggctttttcttttttttcttcttcttttatcctagaaaggttataattctttgcaagcttctctactaattctaaaaaacgcttattctcagtttcataatctgttgctgccagtatatcgtaatatatttttttattaaacatgtcaaaaaatatcacatcttctcctcttattttaacagccactgggggaagtattctatttacaggataagcttgtgtatctgcttttttaataagtttctcttcttcctctgttaaatcttctccaaaaagtggttcaattactttagatttaattaaaatctcatggcatcgacctttttcgtgaagctggaacttttttatacattcttcattgtccatagaaattatccaatgcttatgaggagggtcatgaagaaaagctttaagtttcagaagccatactttttccat

SEQ ID NO: 141 - protein, 907 aa, Carboxydibrachium pacificum
MEKVWLLKLKAFLHDPPHKHWIISMDNEECIKKFQLHEKGRCHEILIKSKVIEPLFGEDLTEEEEKLIKKADTQAYPVNRILPPVAVKIRGEDVIFFDMFNKKIYYDILAATDYETENKRFLELVEKLAKNYNLSRIKEEEKKEKAKILLLFLWRFYQEIFHWMRIHPADTRAPNHSIYDHLVQTSTLVSALPKPAFLLFTIGPVQSFIATARKTSDLWAGSYMLSYFIWKIMKFVVERYGADVIVYPNLLGQPLVDLWLSSEVFGNLLTHLSQKEFDEWFKEWNNIPRSKGLEEKLSIANMPNRFLAIVPINEGEALKLGEKCEKNFKEQLKSLAKKTVKRLESILNLEGDLEKIQLQIENQLLNYFQVYWVVMPWFEKKESPKEVLDDYKEIIGETELYKTISEFIESVPKIWSKNKEKDEEYRDFSIAYSLLLELTEKLLGARKSMREFEHLEQKGRKCSLCGEFEVLPLDWEKLRSKEKGLVKEKEQLCGVCLAKRLFPKVMKEELSLSEEMKFPSTSEMATIGEKRRIADNKEFIAEFKKLFGEFKQKLLLPNTVSVPKLKDNQLFEIDGQWLMRESYREEYIKSEHTENFKVEEFQKMSQKITKLLEKHRVNPSRYYAILQMDGDHMGKWLKGENNPPIMETLHPKVGEHIKQHAKDNLSSILCKKHPTTPSLHQTLSRKISTFALQEVQRIVEETHYGKLVYAGGDDVLALLPVEEVLECAYELQNAFKEVLSSEASMSAGIVIVHHKYPLYLALKEVQLAQKKAKDERQYNRNAFCLKFIKGSGALKECGGKWALMDFLRGLIEHFKKGEFSSTFPYQFFEVVDRLYDDENKEQVIGILRNELKRIFLRQSGNRDILEKYASEILLPKFDEIVKETPDRVIDFANMLIIARSIAMEARI

SEQ ID NO: 142 - DNA, 3759 bp, Sorangium cellulosum
atgagcgagcgggatcgagaccgagatcgaaacctcgctgtcgctcatcccgtccacggcaggaccggagatgacgagatcgagcaccatgggacggaggcggatcggacccgcttctggcagcaaaagctccttcagctcctgcacgatcccccgggaaaggcgttcttcctccgacagggcgcgggcggacacaaggcggtcgcggcggatctgttccaggcgacggcgggcgttccgctcaagtatgtacggcccggaccggactgggcggcttcgggcgcggaccggccggtcagctccccgccacgtccagcgcacgtctcggtggactgggtgaagaacccgatcctgacgcaccccctcgcctccgggaccgccgccatcgacctcggccgccgggacctgccagcgtcgcgcgagcaggtgcgagcgctcgccggggacgtcggccgcacgctccgcgagctcctcgagcggcgggtgtcccaggaggacgagctcgacgacctccccgaagaagaggagcgcgagcgcttcctgagcgagcgcgccgagcaggtggaaagcgagctcgccgcactgccccgctggcacgacgacgcgcggctccagcaggcgtgcttgcagctctggcgccgcttgcccgaagagccgccgcccggcgtggccgaggtggtctggcggcaccagcccgcagactcgagggccccggatcacagcctctgggatcacctgcgcgtcacctcgtcgctctcgttcctgagcgggaggaggcgcgaggggcccgtcatgccatggctcctcgccttcagcctcggcccggtgcagcggttcatcgcgcagtcgcggacatccaccgatctctggacgtcatccatgctgctgtcggatctcgtgtggcacgccatggtgccgttcgtcgagcggtacggtccggaggcgatcgtgtaccccgatctgcgggccaacccgcgcgctgacgtgtggctctgggagcaggcgaacggggcggacggagccgcgccgccggcgcacgcggcgcggtaccaggacgtcctgcccgagcagctcaatccgtgctcctacgccgggatcttccccaacacgttcatcgcgctggtcccgctcggcggcgagcgctacctgacgctgctcaaggatctcgcgggcgaggcgcgccgcgccgtcctcggccgctggagacagctcgcggacctcgccaggcgctacttcctggagcaggccgcgaagcgccccgaggccatgagcgactccgagcggaaggccttcgaggccacgtgggcccgccagcacgaggacgtgctcttcacgtcctggtccgcggcggcgtggccgagcatcgagcgcgtcaacgacccggagtcgctggccatccgtgaggcgctcgtcgcgcagcgccccgcccaggcgctcccacgcgaggacgcggaggcgctcgcggcgtggcgcgagcgccacacgacatggatcccgggcgagacgttcgcgcgctacgcggaggcccgttatgtctacgcgcggacgaaccgcaccgtgcaccagtgcgagcgcgggttcgactatccgctcctccatcatgcgctggtgtcgcgccacgggctgcgaaaggcagaggcgcagggcgcggcgatcgcggaggagtccggagagaagtgcacgctctgcgggctgcgccaggccctcggcgccggggacgcgggggcgagcgtggacgcgcagcgcgagacagcgcgcgcgttctggcgccgcttcgaccgcaacagcgacgacggggcggagcgcctctgcgccgtgtgcacgatgaagcgcgtcctcgttcgcgccggcgtcgccacggacgagcgcggcgctcgtcgccgggtgggcctcaccgccgcgtgggcggggccggcgacgccgctcgacgacgtgtgtgatcgcgatgagctgcgggtgccgttcccgtcgacggcgacgatcgctgcccagggctacctgtgcgccgtggccacccgccgggagctgcaggcgcaggtcgccgaggtggtgcggtgttgcgaggacgcgaggctgccgcgcacgagcttcgtgcggtcgctgcgatcgctggccgaggcggcgcagcgcgcggacggcgcggggctgcgcttcctcgagtacgaggcggagctcacggtcttccccgaggtgctcgcggcggccgaggagcgcgccccggagggcggcggccgagagcaaggcgacggcgccgcgcagcgcggcgggctgcgcgatcgcgacggcaagcgcgtcccccggtcgaaggtcgaggccctgcgccgcgccgtggagagcctgcgccgggcagcgaaggagctcgatcgaccggccgggtcggcgcggcgcgccggggaccgcattcccgcgccgggcagccaggtcgcgctgatcgcgctggacggcgaccggatcagccagatcctcctgggcgagaagatcggcgctcgctggcgcgacgtgatccatcccgaggccgtcgcgacgatggagagcaacgaggtcacccgcgcggcccgctggccggagctcctcggtcgcaagcgcctcatggggccatcgacgcacgccttcgtcaaccgcgtgctggccgagttcgcgcacaccatcgtcccctgggtggtggagcgggagttcagcgggaggctcatctacgcgggcggagacgacgtgctcgccatcgccccggcgggcgaggcgctcgacctctgcgcgcggctcgcgcagctctacagcgccgcgtgggtcctcgacacgtcacccggcgaagggccgtgggcgtggcgcgcgaagacctggacgagctccacgtccatccgggccagcgagcgcttcgtcgttgtcgcgccgagcgagaccggagagccgctcccctggccgatccccgaggcgtcgaggcgcgggccgatccctgccggggacgccgcagcggcgagcgccgccgagagcgccgaggagcgcctgctcccgatgatgggcgcgggccagacgctctccgccgggatcgcgatcggccactacaagacctctctcggcggcctggtgaaggccgcctgggacgagcgcgatcgggtgaaaggcgaggacgaggagcgcgattgcgcgaaggaggacaacgaggagcgcatccgggtgaagggcgatgacgaggagcgcgacagggcgacgagggaggacctcgccgtcaagaacgccttctcgatccggcggtacacgcgcgggggcgagaaggcgcggctgcgcctctcctggggacggcgttgcgccgcccccgggaaggcgctcgcaggctacctgcgggtgaaggccgtcatcgagggtttcaagaccggcgcgctccccggaaggcttccgtacaagctgcgcgaggtcgagggagccgtgctcgccgcgtggctcgtcgaggcgaaggcgctgcccggcggcctgacgagccgcgaggcccggcgcgagctcgtgaagcgggtcgagccctttgccaggggcctgttcggggcgcagtgcgcggcggaggtggagggagctttcgagatctggtggcaagggctcctgagcgcgcttcgcgcgcacgagcgacgatggagggcgccggacgcggtgccccctggcgcgacccccgtcgacgacggcgcgccgtcgcgcgggctcggctcggagcaggggctggcggtgtgtcgcttcctgggagcgctcgcccgcggggaggaggacgcgcaatga

SEQ ID NO: 143 - protein, 1252 aa, Sorangium cellulosum
MSERDRDRDRNLAVAHPVHGRTGDDEIEHHGTEADRTRFWQQKLLQLLHDPPGKAFFLRQGAGGHKAVAADLFQATAGVPLKYVRPGPDWAASGADRPVSSPPRPAHVSVDWVKNPILTHPLASGTAAIDLGRRDLPASREQVRALAGDVGRTLRELLERRVSQEDELDDLPEEEERERFLSERAEQVESELAALPRWHDDARLQQACLQLWRRLPEEPPPGVAEVVWRHQPADSRAPDHSLWDHLRVTSSLSFLSGRRREGPVMPWLLAFSLGPVQRFIAQSRTSTDLWTSSMLLSDLVWHAMVPFVERYGPEAIVYPDLRANPRADVWLWEQANGADGAAPPAHAARYQDVLPEQLNPCSYAGIFPNTFIALVPLGGERYLTLLKDLAGEARRAVLGRWRQLADLARRYFLEQAAKRPEAMSDSERKAFEATWARQHEDVLFTSWSAAAWPSIERVNDPESLAIREALVAQRPAQALPREDAEALAAWRERHTTWIPGETFARYAEARYVYARTNRTVHQCERGFDYPLLHHALVSRHGLRKAEAQGAAIAEESGEKCTLCGLRQALGAGDAGASVDAQRETARAFWRRFDRNSDDGAERLCAVCTMKRVLVRAGVATDERGARRRVGLTAAWAGPATPLDDVCDRDELRVPFPSTATIAAQGYLCAVATRRELQAQVAEVVRCCEDARLPRTSFVRSLRSLAEAAQRADGAGLRFLEYEAELTVFPEVLAAAEERAPEGGGREQGDGAAQRGGLRDRDGKRVPRSKVEALRRAVESLRRAAKELDRPAGSARRAGDRIPAPGSQVALIALDGDRISQILLGEKIGARWRDVIHPEAVATMESNEVTRAARWPELLGRKRLMGPSTHAFVNRVLAEFAHTIVPWVVEREFSGRLIYAGGDDVLAIAPAGEALDLCARLAQLYSAAWVLDTSPGEGPWAWRAKTWTSSTSIRASERFVVVAPSETGEPLPWPIPEASRRGPIPAGDAAAASAAESAEERLLPMMGAGQTLSAGIAIGHYKTSLGGLVKAAWDERDRVKGEDEERDCAKEDNEERIRVKGDDEERDRATREDLAVKNAFSIRRYTRGGEKARLRLSWGRRCAAPGKALAGYLRVKAVIEGFKTGALPGRLPYKLREVEGAVLAAWLVEAKALPGGLTSREARRELVKRVEPFARGLFGAQCAAEVEGAFEIWWQGLLSALRAHERRWRAPDAVPPGATPVDDGAPSRGLGSEQGLAVCRFLGALARGEEDAQ

SEQ ID NO: 144 - DNA, 2181 bp, Thermoanaerobacterium thermosaccharolyticum
ctattctccctcctttccgataaaagcagatatttcgattagttttaagaaattgtcaatatcatcatcatatttgtgatataaatttttaagtacatcggagatttctttagaaatattctttttttcttctttcccgatatttccactaacagtatcgacggctcttaaaacaactctttttatctccgtattaataatacccgtttcggcaatataatttccgcatttatctttaagtttcgcaaattcttctgctagagtataaactattcttctagaaattcgcaccccactttgattccttctaaagaggtacgataattctttcaatatctccagaacatccatatcaccgtatttccacttgcttactattattttttcttctcctgaacgcttcaataatgaaatagcaaaactatccttctcagtattgcttttggcttttttttctgtttctcttactttatccataaccatttttaacggcgttttataatgagcaatcactaccccacaagacgcagttgcgttcttgcccattgttaaaagtaattttccatctttttcaacaaaacctgtgttattactccaatctactttgatttcattattttctatctttatatgtcctgaaaaggctgctcttaatcttctcatcacttcaaatagatcttttaaattaacgaaagcaagcacatcgtctccacctgaataaattagtttacctaaatgatcatcttcaactattttctttacgaactcaagactataatttctcaaagatagtgaaattaaagagtggatcgtaggagcaagaagtttattctttatagatgtttttaactcttctttcactttattaggtaatttattccataaatcagaaccatatatatgctcaaagttgtgtaacaatttacctgcaagccattctcccatattatctccatcaaataaaacaacggcgtagtaaggattaggctcccctactttgtctgtaatttgtttaagtgattttctcaaatcctctatttctttatcatctatttcaataccaaactgctttttgatattttctgtacataaattttcctcaaaaaaccattctccctcgatatttacaacattattaaaatcaccttcaattttgttcaaaggcttaacttgtatttgtcttagcacattttctccaactatttttttaatatcatcaatatatgcattaaactgtacttctgcatctttcaaagctctctttttaaaattagatgaagccatttctgcagtagatggaaaagtatagtctataaatttaccatcaaccttatcacctaaatatttatccaaagctcttttaacaaaacaaggtatacaaagtgcctctttttcacttatgtatttacctacttgtaaactccccattcctgcctttattactccctcttttgtaccgcatatattacatttcttcccatattcattgatttggctaaaattcctcaaattttttcttatacccatagacttttcaagggcagaatagccaaggtgatagattaaaccaacgttttctttttggacttcctcaaagaaatctttaaagtcctcttcagtaatatatcttccatcttttttaaaaggcatagctacccagtaaatttcaggaaaatctagtgtctgtttttttattactgcattacaatcctcatctttcttatctaacctaattttatctattaatttaaacttatttaaaactatatcaaccatctctttccatttttttctaacaatatcctccattttatgtgccaattttattattttactttcttcactttctggtatcaaagccacaaatctattaggaatcgtaggctgatcaataaatgacgaaatagaagatttcctgtttatattacatcttttcaaatgccattccattaaaggctgagcagaaagattaggataaattatgcttttaggaccatacctatcaattacttcttccataccaataaaagttaaatatgaaagcaaaaaacttcccataaataaatcctgggtctttctcgcttgagaaataaattgctgtactggccctatagtaaagagaaaaagagaaacgttgctgctattctcagcgaaactctcgtatattttctcctccatcat

SEQ ID NO: 145 - protein, 726 aa, Thermoanaerobacterium thermosaccharolyticum
MMEEKIYESFAENSSNVSLFLFTIGPVQQFISQARKTQDLFMGSFLLSYLTFIGMEEVIDRYGPKSIIYPNLSAQPLMEWHLKRCNINRKSSISSFIDQPTIPNRFVALIPESEESKIIKLAHKMEDIVRKKWKEMVDIVLNKFKLIDKIRLDKKDEDCNAVIKKQTLDFPEIYWVAMPFKKDGRYITEEDFKDFFEEVQKENVGLIYHLGYSALEKSMGIRKNLRNFSQINEYGKKCNICGTKEGVIKAGMGSLQVGKYISEKEALCIPCFVKRALDKYLGDKVDGKFIDYTFPSTAEMASSNFKKRALKDAEVQFNAYIDDIKKIVGENVLRQIQVKPLNKIEGDFNNVVNIEGEWFFEENLCTENIKKQFGIEIDDKEIEDLRKSLKQITDKVGEPNPYYAVVLFDGDNMGEWLAGKLLHNFEHIYGSDLWNKLPNKVKEELKTSIKNKLLAPTIHSLISLSLRNYSLEFVKKIVEDDHLGKLIYSGGDDVLAFVNLKDLFEVMRRLRAAFSGHIKIENNEIKVDWSNNTGFVEKDGKLLLTMGKNATASCGVVIAHYKTPLKMVMDKVRETEKKAKSNTEKDSFAISLLKRSGEEKIIVSKWKYGDMDVLEILKELSYLFRRNQSGVRISRRIVYTLAEEFAKLKDKCGNYIAETGIINTEIKRVVLRAVDTVSGNIGKEEKKNISKEISDVLKNLYHKYDDDIDNFLKLIEISAFIGKEGE

SEQ ID NO: 146 - DNA, 2874 bp, Nitrococcus mobilis
tcatgtgtccaagctccgtgtctcccgagccaggaattcggctaccgacagcatgttctcgatgaaatcggcggccttggccgggttctcgacggggcacagcttggccagccgttcggcatggatcggagcgccttctttctccaacttctggcgctggaattggtaatgcagcatttgcccgagcaggcgacggaacggcgcctctccgcctaccgctacgggcttcggtagatcccgcagccagccgcggacgttgtaggcggcccggcgcgaggcgccggcgtttttttgcagcgcggccgagagggtgcggagtgctccgatcacgtcctcgccgcccatctgccagggcagagtgagctcgagggcgccgccggcgcgcttgatgatggtgagtgagaaggcatctcggctgccgcgattatatgccttggccgttttctcggccccccgcagcgcccgcagaaccgcgcccagcggggcctggtgatgggcgataacggcgcccatggaggcagtggcgttttcgcccatggtcagatacagccgtccgcggcgccgcgcgaaaccgttttgaaagcgcatttcgtgagccgcctcgccctcctccggcgccagaccggagtaggcaagacgcaggcggcgcatggcggagagcagatcggagacggcgaacatggccatgaggtcgtcgccgccggcgtagagcacccgcccgatgtgctcgcgctccaccacttcgcgggcgatcaccgtagagaaatcgttcaaggcgccggagatcgccaaatggcggccgggtgagacggcgcgttgcgcgtttagataatcatccagcggggagttgtcctggaagcgcgcttgcaacccggcctgtatttttggatgaaaggcggcgcggtacgggatggtgaagcgctcatcgccggagagccaggcccccatatagtccccgtccatgagcagcagcgcgtaataggtctcgggtttgtagccgagcgcgtgggccagccggctaatggcagcctccgccttgccctcgtcacgctgtgcctcgatccaggccgggatgcgttctatgagctctcgattcgggtgctcgcgcagcttgtcggccaagcgccggggcagggccacacgctcgccgcgttgctcgatttcattgcgcaactcggtgtcgatcgccagtggtgcgtcgcccagtttgtccaaggtagtggccagcgccatggtgtgggtcgagaccacgaaccgcgagaatgacatattgagcgtgtccttgagctcttcgcagaacagcgtcggccacaggcgcttgagcgtggcgagcgcgcccagatgctcgcctttgcgcacccaggtcggccgcttacggccgagccggctccagagagtgtccgcttgatcgcgttggcccggtggtaggctcagatgtgcggggttgtcagtgagccattccgcctcggcggtgagcgagcagcggtagccgtgctgctccagggcgtcgaaagcgcgcacggacttggcggcgacgagcacccgatctacgagatcgtagaccgccgggtacagcacgccgggattgggttggtaaaaggtggccgcgccatcgagctccagcggccggcttagcacccgccaggcgcggctgccgagaaagccgggctctatcgggtcgcccggatagaatgggcgtagcgcctcggcaagcgcgccagtgcggaccttgcgctcaccgtcggcggtcagcgcgctgtagggcaccgccgcccagtgcacctcggggaagccttggagttgctcgcggagttggcgatgagcatgcaggtcgcggcgatcctcgacgccggcctcttgcagcacccgctgcagggcagcctcggtgcgccccacggtccactggcgcagttgttcggtgatgtcttgggcgatggcctcggccgcgctcgcgggcaccagggccaggaaacggttcggcagcgcggcgctgaacagcgggttgccgtcggtagggtcacgcatccaattctgtgcgccaaagaggttgcggtcgagcccgcaatcgcgcaacagccacagatccacctgcgggatgccgcgcagccggggaaataggatggcctccggcccgaggcgctcacagaccacgcgcatggcttcccaggacagccgtgcgagcagatgcgaaccggcccacagatccgaggtggtgcgggccgcggcgatgaactcctgcaccgggccgatgcttatattaagcagggcgcactcgccgtttgcatccgccacgaaggcaccggcgaaggcggagaccagatcgaggtgatcccagatgctatggtcggggatgcgggtatcggccggtaggaagcgccacagctcgccaagccgcgcggtatcatccgcggtgtcgagctccgggccgaagcgccacaatgtgagtgccatccggcgcggatcatcaccgccggcggctttcagcaagcgcttgaaatgggcctgactttggtccttgacggcttcgatcctggtttcgcgcaacccgccctgttggcgcaagtcgaaggccttgccggtcaacgggtgtatgggcaccggctgctcggcgaagttgacctggctccagcgggcatagggtccttctttgccgtcacggggaaactgcggtcggtcggcggcggaggcccaccagtccgccttgcgcacagtcgcgcgtaaatccccggccatgccctgcggaaacaggcgctcgtgcagcacgcggctggtgccgccctcgggaccggcggggtcgcgcagcagcaccagcgctttctcggccggatcgtgcagacgcgcgtgcaacttggcttgccagagtcggtcggtcat

SEQ ID NO: 147 - protein, 957 aa, Nitrococcus mobilis
MTDRLWQAKLHARLHDPAEKALVLLRDPAGPEGGTSRVLHERLFPQGMAGDLRATVRKADWWASAADRPQFPRDGKEGPYARWSQVNFAEQPVPIHPLTGKAFDLRQQGGLRETRIEAVKDQSQAHFKRLLKAAGGDDPRRMALTLWRFGPELDTADDTARLGELWRFLPADTRIPDHSIWDHLDLVSAFAGAFVADANGECALLNISIGPVQEFIAAARTTSDLWAGSHLLARLSWEAMRVVCERLGPEAILFPRLRGIPQVDLWLLRDCGLDRNLFGAQNWMRDPTDGNPLFSAALPNRFLALVPASAAEAIAQDITEQLRQWTVGRTEAALQRVLQEAGVEDRRDLHAHRQLREQLQGFPEVHWAAVPYSALTADGERKVRTGALAEALRPFYPGDPIEPGFLGSRAWRVLSRPLELDGAATFYQPNPGVLYPAVYDLVDRVLVAAKSVRAFDALEQHGYRCSLTAEAEWLTDNPAHLSLPPGQRDQADTLWSRLGRKRPTWVRKGEHLGALATLKRLWPTLFCEELKDTLNMSFSRFVVSTHTMALATTLDKLGDAPLAIDTELRNEIEQRGERVALPRRLADKLREHPNRELIERIPAWIEAQRDEGKAEAAISRLAHALGYKPETYYALLLMDGDYMGAWLSGDERFTIPYRAAFHPKIQAGLQARFQDNSPLDDYLNAQRAVSPGRHLAISGALNDFSTVIAREVVEREHIGRVLYAGGDDLMAMFAVSDLLSAMRRLRLAYSGLAPEEGEAAHEMRFQNGFARRRGRLYLTMGENATASMGAVIAHHQAPLGAVLRALRGAEKTAKAYNRGSRDAFSLTIIKRAGGALELTLPWQMGGEDVIGALRTLSAALQKNAGASRRAAYNVRGWLRDLPKPVAVGGEAPFRRLLGQMLHYQFQRQKLEKEGAPIHAERLAKLCPVENPAKAADFIENMLSVAEFLARETRSLDT

SEQ ID NO: 148 - protein, 7 aa, Artificial sequence
  motif 11
  VARIANT (1)..(1): / replace = "Gly" / replace = "Ser" / replace = "Gln"
  VARIANT (2)..(2): / replace = "Tyr" / replace = "Phe" / replace = "Leu"
  VARIANT (3)..(3): / replace = "Phe" / replace = "Asn"
  VARIANT (5)..(5): / replace = "Ser"
  VARIANT (6)..(6): / replace = "Ser"
  VARIANT (7)..(7): / replace = "Pro" / replace = "Leu"
ARLHDPA

SEQ ID NO: 149 - protein, 8 aa, Artificial sequence
  motif 12
  VARIANT (2)..(2): / replace = "Gln"
  VARIANT (3)..(3): / replace = "Glu" / replace = "His"
  VARIANT (4)..(4): / replace = "Tyr" / replace = "Ser"
  VARIANT (5)..(5): / replace = "Ile"
  VARIANT (6)..(6): / replace = "Phe" / replace = "Ala" / replace = "Leu"
  VARIANT (8)..(8): / replace = "Asn"
PADTRIPD

SEQ ID NO: 150 - protein, 9 aa, Artificial sequence
  motif 13
  VARIANT (1)..(1): / replace = "Ser"
  VARIANT (2)..(2): / replace = "Ile" / replace = "Phe"
  VARIANT (3)..(3): / replace = "Ser" / replace = "Asn"
  VARIANT (5)..(5): / replace = "Ile"
  VARIANT (7)..(7): / replace = "Ser" / replace = "Gln" / replace = "Asp" / replace = "Arg"
  VARIANT (8)..(8): / replace = "Phe" / replace = "Tyr"
TLGPVQELI

SEQ ID NO: 151 - protein, 12 aa, Artificial sequence
  motif 14
  VARIANT (2)..(2): / replace = "Phe"
  VARIANT (3)..(3): / replace = "Tyr" / replace = "Phe"
  VARIANT (4)..(4): / replace = "Trp" / replace = "Met" / replace = "Thr"
  VARIANT (5)..(5): / replace = "Ser"
  VARIANT (7)..(7): / replace = "Tyr" / replace = "Trp" / replace = "Phe" / replace = "Met"
  VARIANT (8)..(8): / replace = "Ile" / replace = "Met"
  VARIANT (10)..(10): / replace = "Ser" / replace = "His"
  VARIANT (11)..(11): / replace = "Tyr" / replace = "Asp"
  VARIANT (12)..(12): / replace = "Phe"
DLWAGSHLLARL

SEQ ID NO: 152 - protein, 5 aa, Artificial sequence
  motif 15
  VARIANT (1)..(1): / replace = "Ile" / replace = "Val"
  VARIANT (2)..(2): / replace = "Tyr" / replace = "Thr"
  misc_feature (4)..(4): Xaa can be any naturally occurring amino acid
LFPXL

SEQ ID NO: 153 - protein, 5 aa, Artificial sequence
  motif 16
  VARIANT (1)..(1): / replace = "Met" / replace = "Phe" / replace = "Ile"
  VARIANT (4)..(4): / replace = "Val" / replace = "Thr"
  VARIANT (5)..(5): / replace = "Ile" / replace = "Leu"
LPNRF

SEQ ID NO: 154 - protein, 6 aa, Artificial sequence
  motif 17
  VARIANT (1)..(1): / replace = "Leu" / replace = "Gly" / replace = "Phe"
  misc_feature (5)..(5): Xaa can be any naturally occurring amino acid
  VARIANT (6)..(6): / replace = "Ile"
MDGDXM

SEQ ID NO: 155 - protein, 10 aa, Artificial sequence
  motif 18
  VARIANT (1)..(1): / replace = "Thr" / replace = "Gly" / replace = "Ala"
  VARIANT (3)..(3): / replace = "Gly" / replace = "Ser" / replace = "Thr"
  VARIANT (4)..(4): / replace = "Val" / replace = "Leu" / replace = "Thr" / replace = "Ile"
  VARIANT (6)..(6): / replace = "Ser" / replace = "Gln" / replace = "Asn" / replace = "Val" / replace = "Ala"
  VARIANT (7)..(7): / replace = "Leu" / replace = "Thr" / replace = "Gly" / replace = "Phe"
  VARIANT (8)..(8): / replace = "Leu" / replace = "Val"
  VARIANT (9)..(9): / replace = "Asn"
  VARIANT (10)..(10): / replace = "Glu" / replace = "Arg" / replace = "Leu"
SPARHLAISG

SEQ ID NO: 156 - protein, 13 aa, Artificial sequence
  motif 19
  VARIANT (2)..(2): / replace = "Lys"
  VARIANT (3)..(3): / replace = "Leu"
  VARIANT (4)..(4): / replace = "Ile"
  VARIANT (6)..(6): / replace = "Ser"
  VARIANT (11)..(11): / replace = "Val"
  VARIANT (12)..(12): / replace = "Phe" / replace = "Leu"
  VARIANT (13)..(13): / replace = "Thr"
GRVLYAGGDDLMA

SEQ ID NO: 157 - protein, 12 aa, Artificial sequence
  motif 20
  VARIANT (1)..(1): / replace = "Ser"
  VARIANT (2)..(2): / replace = "Met" / replace = "Ile" / replace = "Leu"
  VARIANT (4)..(4): / replace = "Ala" / replace = "Phe" / replace = "Cys" / replace = "Leu"
  VARIANT (6)..(6): / replace = "Val" / replace = "Ile" / replace = "Leu"
  VARIANT (7)..(7): / replace = "Thr" / replace = "Ala"
  VARIANT (9)..(9): / replace = "Val" / replace = "Gly"
  VARIANT (10)..(10): / replace = "Asp"
  VARIANT (11)..(11): / replace = "Tyr" / replace = "Lys"
  VARIANT (12)..(12): / replace = "Gln" / replace = "Ser"
TASMGAVIAHHK

SEQ ID NO: 158 - protein, 22 aa, Artificial sequence
  motif 21
  VARIANT (7)..(7): / replace = "Ile" / replace = "Met"
  VARIANT (8)..(8): / replace = "Arg" / replace = "Lys"
  VARIANT (15)..(15): / replace = "Trp"
  VARIANT (16)..(16): / replace = "Ile"
IKASRKFLDFWAGSYLLHYLSA

SEQ ID NO: 159 - protein, 8 aa, Artificial sequence
  motif 22
  VARIANT (2)..(2): / replace = "Leu"
LATAGFPN

SEQ ID NO: 160 - protein, 17 aa, Artificial sequence
  motif 23
  VARIANT (6)..(6): / replace = "Thr" / replace = "Arg" / replace = "Ile"
  VARIANT (8)..(8): / replace = "Arg" / replace = "Lys"
  VARIANT (12)..(12): / replace = "Thr"
  VARIANT (14)..(14): / replace = "Ile" / replace = "Thr"
  VARIANT (15)..(15): / replace = "Val" / replace = "Leu"
GLFDGSEMLNALELTKR

SEQ ID NO: 161 - protein, 19 aa, Artificial sequence
  motif 24
  VARIANT (6)..(6): / replace = "Ser"
  VARIANT (9)..(9): / replace = "Ser" / replace = "Asn"
  VARIANT (10)..(10): / replace = "Ala"
  VARIANT (12)..(12): / replace = "Ser"
KRMGPATHVGLNRALLDFS

SEQ ID NO: 162 - protein, 7 aa, Artificial sequence
  motif 25
  VARIANT (2)..(2): / replace = "Ala"
YSGGDDV

SEQ ID NO: 163 - protein, 34 aa, Artificial sequence
  motif 26
  VARIANT (4)..(4): / replace = "Leu"
  VARIANT (6)..(6): / replace = "Lys" / replace = "Ser" / replace = "Gln" / replace = "Asp"
  VARIANT (7)..(7): / replace = "Cys" / replace = "Leu" / replace = "Ala" / replace = "Asn"
  VARIANT (9)..(9): / replace = "Ser"
  VARIANT (10)..(10): / replace = "Ile"
  VARIANT (12)..(12): / replace = "Phe"
  VARIANT (14)..(14): / replace = "Val" / replace = "Leu"
  VARIANT (15)..(15): / replace = "Thr"
  VARIANT (17)..(17): / replace = "Ala"
  VARIANT (18)..(18): / replace = "His"
  VARIANT (19)..(19): / replace = "His"
  VARIANT (21)..(21): / replace = "Ile"
  VARIANT (24)..(24): / replace = "Ala"
  VARIANT (25)..(25): / replace = "Ile"
  VARIANT (29)..(29): / replace = "Ser" / replace = "Asn"
  VARIANT (32)..(32): / replace = "Gln"
LFTMGFGATMSLGIVIVDKSVPLPVALEALWEAE

SEQ ID NO: 164 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 165 - DNA, 57 bp, Artificial sequence
  primer: prm14240
ggggacaagtttgtacaaaaaagcaggcttaaacaatgtctgaagtttactggcaag

SEQ ID NO: 166 - DNA, 53 bp, Artificial sequence
  primer: prm14239
ggggaccactttgtacaagaaagctgggtttaattgggaaatttaatgtaacg

SEQ ID NO: 167 - protein, 370 aa, Capsicum annuum
MASDLETRAKEAFIDDHFELAVDLYTQAISLSPKNPELFADRAQANIKLNYFTEAVVDANKAIELDPYMSKAYLRKGLACMKLEEYQTAKAALETGASLAPGESRFTKLMKECDESIAEEAGELPNISLEKPSANAVASSASELSDNVAIAPRDPQSTVTLSHQESAAKPKYRHEFYQKPEEVVVTIFAKGIPAKNVVVDFGEQILSVSIDLPGGETYSFQPRLFGKITPAKCRYEVMSTKIEIRLAKAEPLHWTSLDYTREPVVIHRPVVSSAAPRPSYPSSKLRNVDWDKLEAQVKKEEKDEKLDGDAALNKFFRDIYKDADEDTRRAMMKSFVESNGTVLSTNWKEVGTKKVEGSPPDGMELKKWEI

SEQ ID NO: 168 - protein, 370 aa, Nicotiana benthamiana
MASDLETRAKEAFIDDHFELAVDLYTQAIAMTPKNAELFADRAQANIKLNYFTEAVVDANKAIELDPSMSKAYLRKGLACMKLEEYQTAKAALETGASLAPAESRFTKLIKECDERIAEEAGELPNQSVDKTSGNVVAPPASESLDNVAVAPKDAQPTVNLSYQGSAARPKYRHEFYQKPEEVVVTIFAKGIPAKNVVVDFGEQILSVSIDVPGDETYSFQPRLFGKITPAKCRYEVMSTKIEIRLAKAEPLHWTSLEYTRASAVVQRPNVSSDAPRPSYPSSKLRHVDWDKLEAEVKKEEKDEKLDGDAALNKFFRDIYKDADEDTRRAMMKSFVESNGTVLSTNWKEVGTKKVEGSPPDGMELKKWEI

SEQ ID NO: 169 - protein, 373 aa, Hordeum vulgare
MAAAAASDLESKAKEAFVDDDFELAAELYTQAIEAGPATAELYADRAQAHIKLGSYTEAVADANKAIELDPSMHKAYLRKGSACIKLEEYQTAKAALEVGSSYASGDSRFTRLMKECDDRIAEEASQAPVKNAAAAVAPATSSGATTVVTEAEDQDGENMENAQPTVEVPSKPKYRHDYYNTPTEVVLTIFAKGVPADSVVVDFGEQMLSVSIELPGEEPYHFQPRLFSKIVPDKCKYTVLSTKVEIRLAKAEPVTWTSLDYTGKPKAPQKINVPAESAQRPSYPSSKSKKDWDKLEAEVKKQEKDEKLDGDAALNKFFREIYSDADEDMRRAMMKSFVESNGTVLSTNWKDVGKKTVEGSPPDGMELKKWEY

SEQ ID NO: 170 - protein, 367 aa, Oryza sativa
MATAAASDLESKAKAAFVDDDFELAAELYTQAIEASPATAELYADRAQAHIKLGNYTEAVADANKAIELDPSMHKAYLRKGAACIRLEEYQTAKAALELGYSFASGDSRFTRLMKECDERIAEELTEVPVKKAEDGAAAPSVASFVEEKDDAANMDNTPPMVEVKPKYRHDFYNSATEVVLTIFAKGVPAENVVVDFGEQMLSVSIEVPGEEPYHFQPRLFSKIIPEKSRYQVLSTKVEIRLAKAEQITWTSLDYDKKPKAVPQKIIPPAESAQRPSYPSSKSKKDWDKLEAEVKKEEKEEKLEGDAALNKFFRDIYSDADEDMRRAMMKSFVESNGTVLSTNWKDVGSKKVEGSPPDGMELKKWEY

SEQ ID NO: 171 - protein, 355 aa, Brassica oleracea
MASELAEKAKEAFLEDDFDVAVDLYSRAIDLDPNCAAFFADRAQANIKILNFTEAVADANKAIELEPTLSKAYLRKGTACMKLEEYSTAKAALQKGASVAPNESKFNKLIDECNLHIAEEEKDLAQQMPPTLPSSSTTPPLATAADSPPAAPAKPMFRHEFYQKPEEVVVTVFAKGIPKQNLNVEFGDQILSVVIDVAGEEAYHFQPRLFGKIIPDKCRYEVLSTKVEIRLAKAEIITWASLEYVKGQALLPKPNVASAVSQRPVYPSSKPAKDWDKLEAEVKKQEKDEKLDGDAAMNKFFSDIYQSADEDMRRAMNKSFAESNGTVLSTNWKEVGTKKVESTPPDGMELKKWEY

SEQ ID NO: 172 - protein, 358 aa, Arabidopsis thaliana; identical to SEQ ID NO: 8

SEQ ID NO: 173 - protein, 350 aa, Arabidopsis thaliana
MAKELADKAKEAFVDDDFDVAVDLYSKAIDLDPNCAEFFADRAQAYIKLESFTEAVADANKAIELDPSLTKAYLRKGTACMKLEEYRTAKTALEKGASITPSESKFKKLIDECNFLITEEEKDLVQPVPSTLPSSVTAPPVSELDVTPTAKYRHEYYQKPEEVVVTVFAKGIPKQNVNIDFGEQILSVVIEVPGEDAYYLQPRLFGKIIPDKCKYEVLSTKIEIRLAKADIITWASLEHGKGPAVLPKPNVSSEVSQRPAYPSSKKVKDWDKLEAEVKKQEKDEKLEGDAALNKFFREIYQNADEDMRRAMSKSFVESNGTVLSTNWQEVGTKTIESTPPDGMELKKWEI

The invention claimed is:

1. A method for enhancing a yield-related trait in a plant relative to a corresponding control plant under non-stress conditions, comprising introducing and expressing in a plant a nucleic acid encoding
    an SGT1 polypeptide having at least 90% sequence identity to the amino acid sequence of SEQ ID NO: 2 and comprising the the following in any order:
    a) at least one tetratricopeptide (TPR) repeat;
    b) at least one CS domain; and
    c) an SGS domain.

2. The method of claim 1, wherein the enhanced yield-related trait comprises increased yield, increased biomass, and/or increased seed yield relative to a corresponding control plant.

3. The method of claim 1, wherein the plant has an enhanced yield-related trait relative to a corresponding control plant under conditions of drought stress or salt stress.

4. A construct comprising:
    (i) a nucleic acid encoding an SGT1 polypeptide having at least 90% sequence identity to the amino acid sequence of SEQ ID NO: 2 and comprising the following in any order:
        1) at least one tetratricopeptide (TPR) repeat;
        2) at least one CS domain; and
        3) an SGS domain;
    (ii) one or more heterologous control sequences capable of driving expression of the nucleic acid of (i) in a plant cell; and optionally
    (iii) a transcription termination sequence.

5. A method for making a plant having increased yield, increased biomass, and/or increased seed yield relative to a corresponding control plant, comprising transforming a plant with the construct of claim 4.

6. A plant, plant part, or plant cell comprising the construct of claim 4.

7. A method for the production of a transgenic plant having increased yield relative to a corresponding control plant, comprising:
   i) introducing and expressing in a plant or a plant cell a nucleic acid encoding an SGT1 polypeptide having at least 90% sequence identity to the amino acid sequence of SEQ ID NO: 2 and comprising the following in any order:
      a) at least one tetratricopeptide (TPR) repeat;
      b) at least one CS domain; and
      c) an SGS domain; and
   ii) cultivating the plant or plant cell under conditions promoting plant growth and development.

8. A transgenic plant having increased yield relative to a corresponding control plant, resulting from introducing and expressing a nucleic acid encoding the SGT1 polypeptide as defined in claim 1 in said plant, or a transgenic plant cell comprising a recombinant nucleic acid encoding said SGT1 polypeptide that is derived from said transgenic plant.

9. The transgenic plant or the transgenic plant cell of claim 8, wherein said transgenic plant is a crop plant, a monocot, a cereal, rice, maize, wheat, barley, millet, rye, triticale, sorghum, emmer, spelt, secale, einkorn, tell, milo, or oats.

10. Harvestable parts of the transgenic plant of claim 9, wherein said harvestable parts are shoot biomass and/or seeds, and wherein said harvestable parts comprise a recombinant nucleic acid encoding said SGT1 polypeptide.

11. Products derived from the transgenic plant of claim 9 and/or from harvestable parts of said transgenic plant, wherein said harvestable parts are shoot biomass and/or seeds, and wherein said products comprise a recombinant nucleic acid encoding said SGT1 polypeptide.

12. The method of claim 1, further comprising selecting for a plant having an enhanced yield-related trait relative to a corresponding control plant under non-stress conditions.

13. The method of claim 1, wherein said nucleic acid encodes a polypeptide having at least 95% sequence identity to the amino acid sequence of SEQ ID NO: 2.

14. The method of claim 1, wherein said nucleic acid comprises the nucleotide sequence of SEQ ID NO: 1 or encodes a polypeptide comprising the amino acid sequence of SEQ ID NO: 2.

15. The construct of claim 4, wherein said nucleic acid encodes a polypeptide having at least 95% sequence identity to the amino acid sequence of SEQ ID NO: 2.

16. The method of claim 5, further comprising selecting for a plant having increased yield, increased biomass, and/or increased seed yield relative to a corresponding control plant.

17. The method of claim 7, further comprising selecting for a plant having an enhanced yield-related trait relative to a corresponding control plant.

18. The method of claim 7, wherein said nucleic acid encodes a polypeptide having at least 95% sequence identity to the amino acid sequence of SEQ ID NO: 2.

19. The method of claim 7, wherein the enhanced yield-related trait is obtained under non-stress conditions or under conditions of drought stress or salt stress.

20. A transgenic plant obtained by the method of claim 7, or a plant part, seed, or progeny of said plant, wherein said plant, or said plant part, seed, or progeny, comprises a recombinant nucleic acid encoding said SGT1 polypeptide.

* * * * *